US009297803B2

(12) United States Patent
Felgner et al.

(10) Patent No.: US 9,297,803 B2
(45) Date of Patent: Mar. 29, 2016

(54) COMPOSITIONS AND METHODS FOR IMMUNODOMINANT ANTIGENS

(75) Inventors: Philip Felgner, Rancho Santa Fe, CA (US); David Huw Davies, Long Beach, CA (US); Xiaowu Liang, La Jolla, CA (US); Maria Laura Gennaro, New York, NY (US)

(73) Assignees: Immport Therapeutics, Inc., Irvine, CA (US); Rutgers, The State University of New Jersey, New Brunswick, NJ (US)

( * ) Notice: Subject to any disclaimer, the term of this patent is extended or adjusted under 35 U.S.C. 154(b) by 1117 days.

(21) Appl. No.: 12/447,620

(22) PCT Filed: Nov. 1, 2007

(86) PCT No.: PCT/US2007/023299
§ 371 (c)(1),
(2), (4) Date: Dec. 3, 2009

(87) PCT Pub. No.: WO2008/140478
PCT Pub. Date: Nov. 20, 2008

(65) Prior Publication Data
US 2010/0119535 A1 May 13, 2010

Related U.S. Application Data

(60) Provisional application No. 60/856,217, filed on Nov. 1, 2006.

(51) Int. Cl.
| | |
|---|---|
| *A61K 39/12* | (2006.01) |
| *A61K 39/02* | (2006.01) |
| *G01N 33/569* | (2006.01) |
| *A61K 39/015* | (2006.01) |
| *A61K 39/04* | (2006.01) |
| *A61K 39/118* | (2006.01) |
| *A61K 39/245* | (2006.01) |
| *A61K 39/285* | (2006.01) |
| *A61K 39/385* | (2006.01) |
| *C07K 14/005* | (2006.01) |
| *G01N 33/566* | (2006.01) |
| *A61K 39/00* | (2006.01) |

(52) U.S. Cl.
CPC .......... *G01N 33/5695* (2013.01); *A61K 39/015* (2013.01); *A61K 39/0208* (2013.01); *A61K 39/0225* (2013.01); *A61K 39/04* (2013.01); *A61K 39/098* (2013.01); *A61K 39/118* (2013.01); *A61K 39/12* (2013.01); *A61K 39/245* (2013.01); *A61K 39/285* (2013.01); *A61K 39/385* (2013.01); *C07K 14/005* (2013.01); *G01N 33/566* (2013.01); *G01N 33/56911* (2013.01); *A61K 2039/60* (2013.01); *C12N 2710/16621* (2013.01); *C12N 2710/16622* (2013.01); *C12N 2710/16634* (2013.01); *C12N 2710/24122* (2013.01); *C12N 2710/24134* (2013.01); *G01N 2469/20* (2013.01)

(58) Field of Classification Search
None
See application file for complete search history.

(56) References Cited

U.S. PATENT DOCUMENTS

| | | |
|---|---|---|
| 2004/0029129 A1 | 2/2004 | Wang et al. |
| 2004/0132132 A1 | 7/2004 | Sahin et al. |
| 2005/0084904 A1 | 4/2005 | Laal et al. |
| 2005/0244857 A1 | 11/2005 | Ni et al. |
| 2005/0260225 A1 | 11/2005 | Goldberg et al. |
| 2006/0002949 A1 | 1/2006 | Glenn et al. |
| 2006/0034871 A1 | 2/2006 | Grandi et al. |
| 2008/0171345 A1 | 7/2008 | Belisle et al. |

FOREIGN PATENT DOCUMENTS

| | | |
|---|---|---|
| WO | 2006/088492 | 8/2006 |

*Primary Examiner* — Robert A Zeman
(74) *Attorney, Agent, or Firm* — Fish & Tsang, LLP

(57) ABSTRACT

Contemplated compositions, devices, and methods comprise immunodominant antigens from selected human pathogens (*Burkholderia pseudomallei, Borrelia burgdorferi, Brucella melitensis, Chlamydia muridarum, Coxiella burnetii, Francisella tularensis*, human Herpes virus 1 and 2, *Mycobacterium tuberculosis, Plasmodium falciparum*, and Vaccinia virus) can be used as a vaccine, as diagnostic markers, and as therapeutic agents. In particularly preferred aspects, the antigens have quantified and known relative reactivities with respect to sera of a population infected with the pathogen, and have a known association with a disease parameter.

6 Claims, 3 Drawing Sheets

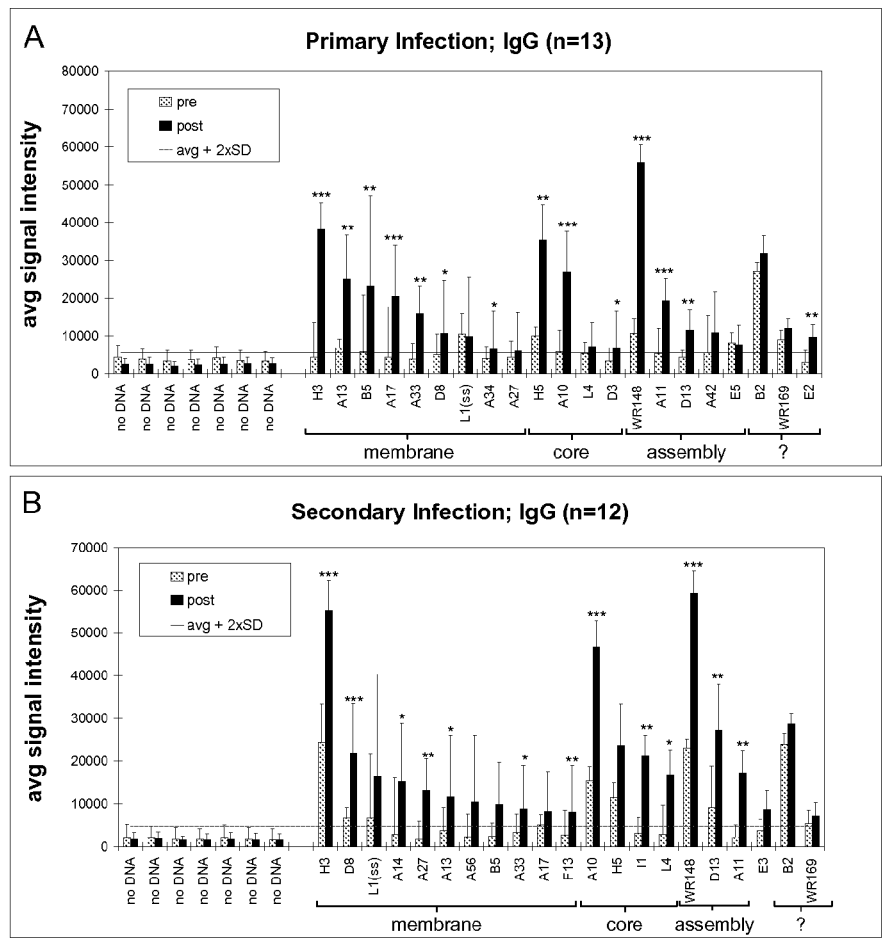
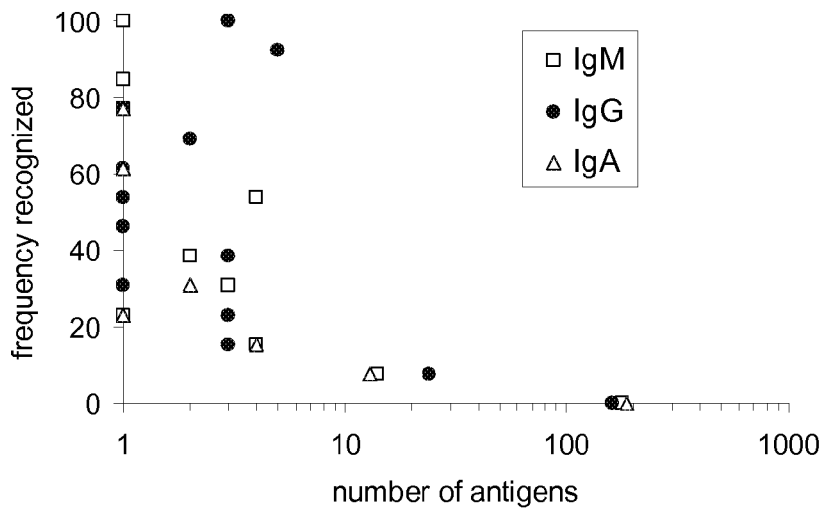
Figure 3
Figure 2

COMPOSITIONS AND METHODS FOR IMMUNODOMINANT ANTIGENS

This application claims priority to our U.S. provisional patent application with the Ser. No. 60/856,217, which was filed Nov. 1, 2006.

FIELD OF THE INVENTION

The field of the invention is immunodominant antigens from pathogens, especially as they relate to their use in diagnostic and therapeutic compositions and methods.

BACKGROUND OF THE INVENTION

Antigens for vaccination and/or diagnostic purposes are typically single antigens from a pathogen, or complex mixtures of multiple and unknown antigens of a pathogen such as inactivated bacteria or viruses. Depending on the particular type of pathogen, single antigens may provide a quantifiable signal in diagnostic test. However, due to variations among individuals in their immune response profiles, single antigen tests are often not sufficient to obtain useful diagnostic information with useful specificity and sensitivity. In addition, where the single antigen is used as a vaccine, variability of individual immune response and potential prior exposure often limit usefulness of single antigens. Finally, while some complex mixtures of multiple and unknown antigens are useful for vaccine development, they typically carry the risk of adverse reactions, or even reactivation of the pathogen.

More recently, multivalent vaccine preparations have become available where in a single dose, multiple and distinct antigens, from multiple and distinct serotypes, of a single pathogenic organisms were combined (Prevnar™: Heptavalent vaccine against *Streptococcus pneumoniae* capsular serotypes 4, 6B, 9V, 14, 18C, 19F, and 23F). While such mixed preparations tend to provide a broader range of protection against different serotypes, various difficulties nevertheless remain. Most significantly, where a single antigen fails to elicit an immune response, coverage to the corresponding serotype is not present. Thus, combination of single defined antigens from several serotypes merely combines benefits and problems associated with the single antigens. Moreover, none of the heretofore known antigens is generally applicable to differentiate among stages, secondary infections, etc., as the signal is either impossible to deconvolute (e.g., compound signal from inactivated pathogen) or only provides a single data point.

Therefore, while numerous methods of identification and use of antigens are known in the art, all or almost all of them suffer from one or more disadvantages. Consequently, there remains a large, unmet need to provide improved compositions and methods of antigens for diagnostic and therapy.

SUMMARY OF THE INVENTION

The present invention is directed to immunodominant antigens from various human pathogens wherein the antigens have predetermined reactivities to serum of a population of patients infected with the pathogen. Thus, immunodominant antigens will have a statistically high probability to elicit an immune response in a relatively large group of patients. Further, where the antigens are determined from selected subpopulations (e.g., primary infection, secondary infection, recovering, chronic etc.), the antigens also have a known association with a disease parameter.

In one aspect of the inventive subject matter, an antigen composition comprises two or more immunodominant antigens of a pathogenic organism and are associated with a carrier, wherein the antigens have quantified and known relative reactivities with respect to sera of a population infected with the organism, and wherein the antigens have a known association with a disease parameter. Most preferably, the antigens are polypeptides and are encoded by nucleic acids having a sequence according to SEQ ID NO:1 to SEQ ID NO:1150 (or comprise fragments thereof).

Thus, in some aspects, the pathogenic organism is *Burkholderia pseudomallei*, and the antigens are encoded by nucleic acids having a sequence according to SEQ ID NO:966 to SEQ ID NO:1150, or the pathogenic organism is *Borrelia burgdorferi*, and the antigens are encoded by nucleic acids having a sequence according to SEQ ID NO:546 to SEQ ID NO:637. In further aspects, the pathogenic organism is *Chlamydia muridarum*, and the antigens are encoded by nucleic acids having a sequence according to SEQ ID NO:1 to SEQ ID NO:134, or the pathogenic organism is *Coxiella burnetii*, and the antigens are encoded by nucleic acids having a sequence according to SEQ ID NO:678 to SEQ ID NO:713. In yet further aspects, the pathogenic organism is *Francisella tulare*, and the antigens are encoded by nucleic acids having a sequence according to SEQ ID NO:663 to SEQ ID NO:677, or the pathogenic organism is human Herpes virus 1, and the antigens are encoded by nucleic acids having a sequence according to SEQ ID NO:638 to SEQ ID NO:654, or the pathogenic organism is human Herpes virus 2, and the antigens are encoded by nucleic acids having a sequence according to SEQ ID NO:655 to SEQ ID NO:662. In still further aspects, the pathogenic organism is *Mycobacterium tuberculosis*, and the antigens are encoded by nucleic acids having a sequence according to SEQ ID NO:749 to SEQ ID NO:965, or the pathogenic organism is *Plasmodium falciparum*, and the antigens are encoded by nucleic acids having a sequence according to SEQ ID NO:135 to SEQ ID NO:445. In yet further aspects, the pathogenic organism is *Brucella melitensis*, and the antigens are encoded by nucleic acids having a sequence according to SEQ ID NO:446 to SEQ ID NO:545, or the pathogenic organism is Vaccinia virus, and the antigens are encoded by nucleic acids having a sequence according to SEQ ID NO:714 to SEQ ID NO:748.

It is further contemplated that the known reactivities may be characterized by a variety of factors, however, it is particularly preferred that the known reactivities are characterized by strength of immunogenicity and/or time course of the infection. Similarly, the particular parameter may vary among different pathogens, however, it is generally preferred that the parameter is a previous exposure to the pathogen, the duration of exposure to the pathogen, a chronic infection, at least partial immunity to infection with the pathogen, and/or an expected positive outcome upon treatment.

In another aspect of the inventive subject matter, the carrier is a pharmaceutically acceptable carrier, and the composition is formulated as a vaccine. In such aspects, it is generally preferred that the vaccine comprises multiple (e.g., at least two, four, or six) antigens, which may be from the same pathogen or distinct (serotypical or species) pathogens. Depending on the particular pathogen, it is contemplated that the antigens or fragments thereof are at least partially purified and/or recombinant.

Alternatively, the carrier may also be a solid carrier, and the plurality of antigens is disposed on the carrier in an array. In such arrays, it is generally preferred that the antigens are from at least two distinct pathogens, and/or have at least two distinct known reactivities and/or parameters. It is further contemplated that the antigens or fragments thereof may be in crude expression extracts, in partially purified form (e.g., purity of less than 60%), or in highly purified form (purity of at least 95%). The antigens in such arrays may be recombinant or native. Alternatively, solid phases need not be limited to planar arrays, but may also include beads, columns, dipstick-type formats, etc.

Various objects, features, aspects and advantages of the present invention will become more apparent from the following detailed description of preferred embodiments of the invention.

BRIEF DESCRIPTION OF THE DRAWING

FIG. 2 is a graph illustrating the relative scarcity of antigen recognition of selected antibody types.

FIGS. 3A and 3B are exemplary graphs depicting the average signal intensities of a plurality of immune responses against various antigens of primary (A) and secondary (B) infections.

DETAILED DESCRIPTION

Figure 1:
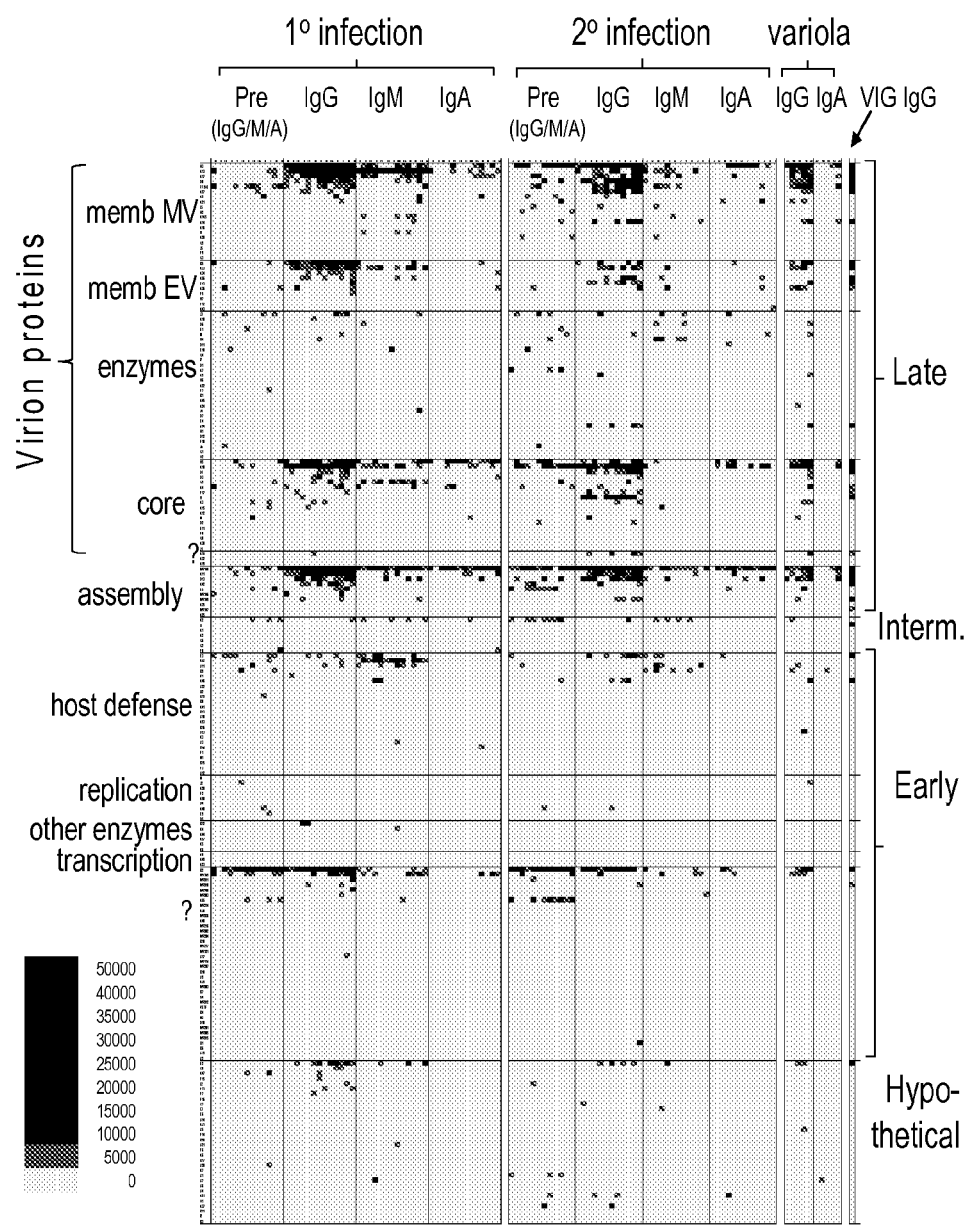
FIG. 1 is an exemplary matrix depicting antibody signals for selected antibody types with respect to potential antigens of an exemplary pathogen.

The inventors have discovered numerous immunodominant antigens from a variety of human pathogens capable of casing infection in humans, including: *Burkholderia pseudomallei*, *Borrelia burgdorferi*, *Brucella melitensis*, *Chlamydia muridarum*, *Coxiella burnetii*, *Francisella tularensis*, human Herpes virus 1 and 2, *Mycobacterium tuberculosis*, *Plasmodium falciparum*, and Vaccinia virus. Immunodominant antigens according to the inventive subject matter are encoded by nucleic acids having a sequence according to SEQ ID NO:1 to SEQ ID NO:1150, and it is generally contemplated that such antigens can be used by themselves, or more preferably, in combination with other antigens (typically also immunodominant antigens) in the manufacture of a diagnostic devices, therapeutic compositions, and vaccines.

As used herein, the term "immunodominant antigen" refers to an antigen that elicits in at least one stage of the disease production of one or more types of antibodies (e.g., IgG, IgA, IgE, IgM, etc.) in at least 40%, more typically at least 70%, and most typically at least 90% of a population exposed to the antigen, and wherein, when compared to other antigens of the same pathogen, the average binding affinity and/or average quantity of the antibodies produced in the patient in at least one stage of the disease is at least in the upper tertile, more typically upper quartile, and most typically upper quintile. Most typically, the average binding affinity and/or average quantity of the antibodies is reflected in the signal intensity and signal intensity can therefore be used as a surrogate marker for average binding affinity and/or average quantity of the antibodies. In further aspects, preferred immunodominant antigens are also characterized by a response in the test group that is considered statistically significant when compared with control signal intensity, wherein the significance level p is preferably equal or less than 0.1, more preferably equal or less than 0.05, and most preferably equal or less than 0.01.

In one aspect of the inventive subject matter, immunodominant antigens are identified from a proteome screen against sera of a population that has been previously exposed to the pathogen. Most preferably, the population is subdivided in several sub-populations to reflect various disease parameters, which can then be correlated with the so identified antigens. It is still further preferred that the screening also provides data on relative reactivities with respect to the antigens and sera of the populations/sub-populations.

With respect to the above pathogens, it is generally preferred that at least part of the pathogen's genome is obtained and all potential open reading frames and splice mutations thereof are determined in silico. Once the potential genes are identified, suitable primers are determined to provide amplicons of the entire Open Reading Frames (ORFs), or, less preferably, portions thereof, wherein the primers are preferably designed to allow facile subcloning into an expression system. Most preferably, the subcloning uses recombinase-based subcloning using unpurified PCR mixtures to avoid cloning bias, and the so obtained recombinant plasmids are polyclonally multiplied, which enables unbiased presentation of the amplicons. It is still further particularly preferred that the plasmid preparations are then subjected to an in vitro transcription/translation reaction to thereby provide the recombinant ORF peptide, which is then spotted or otherwise immobilized onto a suitable addressable carrier (e.g., membrane, bead, etc.).

It should be recognized that the so prepared proteomes can then be exposed to serum of a population of control individuals and/or population of individuals that are known to have current or previous exposure to the above pathogen from which the ORFs were prepared. Antibodies of the serum that bind to one or more of the ORFs are then detected using well known methods (e.g., secondary antibodies). In this manner, the entire proteome of the pathogen can be rapidly assessed for immunogenicity and potential binding with antibodies in serum. Various preferred aspects, compositions, and methods of proteome preparation are disclosed in our copending International patent application with the publication number WO 06/088492, which is incorporated by reference herein.

Therefore, and among various other advantages, it should be especially recognized that contemplated compositions and methods presented herein will allow for preparation of vaccines and diagnostic compositions comprising a plurality of antigens with known and predetermined affinity to target ORFs of a pathogen. As individual immune systems are known to exhibit significant variation with respect to antigen recognition, methods and compositions contemplated herein will allow statistically supported antigen identification to identify immunodominant antigens in a population of patient. Consequently, multiple targets can be used to elicit an immune response and/or detect a prior exposure, even where one or more of the targets may be evasive for detection or provide only a weak response.

With respect to the immunodominant sequences identified herein, it should be further appreciated that the sequences need not be complete ORFs, but that suitable sequences may also be partial sequences (e.g., synthetic, recombinant or isolated) that typically comprise at least part of an antigenic epitope. Thus, sequences contemplated herein may be identified as DNA sequences encoding the antigenic peptide (partial or entire ORF), or may be identified as peptide sequence (or homologs thereof). Similarly, chemically modified antigens, and/or orthologs of the polypeptides presented herein are also deemed suitable for use herein.

It should be particularly noted that while proteome screening will provide a plurality of antigens as potentially useful molecules for diagnosis, vaccination, and/or therapy, such an approach only provides a raw cut of (a plurality) of individual responses. Thus, as most individual immune reactions towards the same pathogen elicit a significantly distinct profile of antibodies (e.g., depending on disease stage, previous exposure, and/or inter-individual variability), results obtained from such screening are typically inhomogeneous. Consequently, variability of the individual immune responses and variability of the quantity of recombinant protein in the array must be taken into consideration to obtain meaningful results.

Therefore, it should be appreciated that filtering of raw data will result in a collection of antigens with quantified and known relative reactivities with respect to sera of a population infected with the pathogen. Moreover, it should be noted that as signals may be specific to a particular stage in the course of an infection, relative reactivities may be indicative of the time course of the infection, and/or relative reactivities may represent differences in the strength of immunogenicity of the particular antigen (or quantity of deposited antigen in the screening assay). Additionally, it should be particularly recognized that depending on the choice of the specific patient population, the tested sera will reflect the immune status of a population that is characterized by one or more parameters of the disease. For example, populations may be observed that are infected or not infected, that had a long-term exposure or chronic infection, that had spontaneous recovery, that represents a group of responders (or non-responders) to a particular drug treatment, or that had at least partial immunity to the pathogen.

In still further contemplated aspects, immunodominant antigens are identified by selecting for an antigen (preferably within a well-defined sub-population) that (a) produces in at least 40-50% of a population a measurable signal, and (b) has a signal strength of at least 40% of the overall average signal intensity. However, and more preferably, the signal strength will be at least above average of the overall average signal intensity, and even more preferably in the upper tertile (quartile, or even quintile) of signal intensities in the assay. Therefore, and viewed from another perspective, immunodominant antigens will preferably be selected in a comparison of at least two series of tests, wherein one series of tests is typically the sub-population (e.g., primary infection, secondary infection, recovering, chronic, etc.) and the other series of tests is the control group (e.g., other sub-population or control group). Still further, it is generally preferred that the series of tests also include a negative control against which the potential immunodominant antigens are compared.

Consequently, and with particular respect to the pathogens presented herein, it should be appreciated that compositions comprising one or more selected immunodominant antigens can be prepared that will have a statistically high probability to elicit or have elicited an immune response in a relatively large group of patients. Further, where the antigens are determined from selected sub-populations (e.g., recovering patients, chronic patients, primary infection, secondary infection, etc.), the antigens also have a known association with a disease parameter and thus allow staging of the disease and/or prediction of therapeutic efficacy. Moreover, as the antigens presented herein are immunodominant antigens, it should be noted that vaccine compositions can be prepared with known or predictable immunogenicity.

For example, numerous antigens of *Burkholderia pseudomallei* (those encoded by nucleic acids SEQ ID NO:966 to SEQ ID NO:1150), *Borrelia burgdorferi* (those encoded by nucleic acids SEQ ID NO:546 to SEQ ID NO:637), *Chlamydia muridarum* (those encoded by nucleic acids SEQ ID NO:1 to SEQ ID NO:134), *Coxiella burnetii* (those encoded by nucleic acids SEQ ID NO:678 to SEQ ID NO:713), *Francisella tularensis* (those encoded by nucleic acids SEQ ID NO:663 to SEQ ID NO:677), Herpes virus 1, Herpes virus 2, and Vaccinia virus (those encoded by nucleic acids SEQ ID NO:638 to SEQ ID NO:654, SEQ ID NO:655 to SEQ ID NO:662, and SEQ ID NO:714 to SEQ ID NO:748, respectively), *Mycobacterium tuberculosis* (those encoded by nucleic acids SEQ ID NO:749 to SEQ ID NO:965), *Plasmodium falciparum* (those encoded by nucleic acids SEQ ID NO:135 to SEQ ID NO:445), and *Brucella melitensis* (those encoded by nucleic acids SEQ ID NO:446 to SEQ ID NO:545) were identified as immunodominant (see also examples and protocol below). With respect to the reading frame for each of the sequences of SEQ ID NO:1 to SEQ ID NO:1150, it should be noted that the first base in the sequences is either the first base of the start codon or the first base in the first codon of the polypeptide that was identified with the methods and compositions provided herein. Most typically, the last three bases denote the stop codon, or the last base of the last codon of the polypeptide that was identified with the methods and compositions provided herein.

In these examples, each of the antigens was characterized, inter alia, with regard to their individual and relative reactivities for each of the pathogens. Most typically, reactivity was measured as strength of immunogenicity (e.g., such that average binding affinity and/or average quantity of the antibodies produced a predetermined signal intensity (e.g., in the upper half, upper tertile, or even upper quartile)). Furthermore, each of the identified antigens was also characterized by association with at least one parameter. In most cases, the disease parameter was acute infection with the pathogen, and in further cases, the disease parameter was also primary and/or secondary infection. Therefore, it should be especially appreciated that identification of immunodominant antigens will not only allow for identification of statistically meaningful antigens for diagnosis, vaccine development, and treatment, but also allow to develop a stage and disease specific tool to identify candidate molecules to fine-tune diagnosis and/or treatment.

For example, suitable diagnostic devices especially include those comprising one or more of the immunodominant antigens, fragments, or analogs thereof that are encoded by nucleic acids according to SEQ ID NO:1 to SEQ ID NO:1150. Depending on the particular device format, the device may have only a single immunodominant antigen, fragment, or analog that may be used for detection of binding of antibodies from blood or serum in an automated manner or by visual observation. For example, where a single immunodominant antigen is employed, suitable devices may be in the format of a dipstick or competitive ELISA. On the other hand, where multiple immunodominant antigens are employed, suitable devices may be in the format of an array that can be read in an automated device (e.g., via scanner) or visual manner (e.g., dye-forming colorimetric reaction). Most typically, in such devices, the plurality of antigens is deposited in a spatially addressable manner (e.g., x-y matrix or mixed beads with color association). Moreover, it should be noted that diagnostic devices contemplated herein may be based on numerous well known manners of detection, including ELISA (sandwich or non-sandwich), competitive ELISA, anti-idiotypic antibodies, etc., wherein all known colorimetric and photometric (e.g., fluorescence, luminescence, etc.) or radiometric reactions are deemed suitable for use.

In most typical devices, a plurality of immunodominant antigens of a single (or multiple) pathogen and/or serotype are deposited onto an addressable solid phase and exposed to blood, serum, plasma or other antibody-containing body fluid. Consequently, so prepared compositions can be employed to identify and/or characterize an immune response of an individual against selected antigens, and optionally assess the kind of immune response (e.g., identification of early, mid, late, or chronic infection), as well as disease progression, efficacy of therapy, etc. Most typically, the plurality of antigens will include at least 2 to 10 antigens, but significantly higher amounts of antigens are also contemplated, including at least 25%, more typically at least 50%, even more typically at least 75%, and most typically at least 90% of the proteome of the pathogen. In further typical aspects of the inventive subject matter, contemplated arrays are most preferably processed in a microfluidic device. For example, an array of antigens in such devices may be printed on a membrane or other material (e.g., nitrocellulose-coated carrier of less than 1 $cm^2$ area) that is then placed in a microfluidic device having sample/reagent inlet and outlet ports. Depending on the specific configuration, signals may be acquired using optical methods (e.g. CCD chip, flat bed scanner, etc.), electrical methods (e.g., voltametric or amperometric), or other methods well known in the art. Alternatively, visual detection or detection using a regular flat bed scanner at 1200 dpi resolution and/or fluorescence detection is also deemed suitable.

In another example, immunodominant antigens according to the inventive subject matter may also be employed to generate an antibody preparation that can be used as a passive vaccination for therapeutic treatment of a disease caused by the above pathogens.

In still further contemplated aspects, the immunodominant antigens presented herein may also be employed in the manufacture of a vaccine that comprises at least one, and more typically at least two of the immunodominant antigens encoded by nucleic acids according to SEQ ID NO:1 to SEQ ID NO:1150. More preferably, however, contemplated vaccines will include between two and five, or at least six, and even more antigens, of which at least one of the antigens is an immunodominant antigen. Such vaccine compositions may be directed to elicit immunity against single or multiple serotypes and may thus comprise distinct immunodominant antigens, optionally from multiple and distinct serotypes and/or species. Moreover, it should be appreciated that vaccines may be produced that predominantly, or even exclusively, comprise immunodominant antigens of a single parameter. For example, a vaccine may comprise immunodominant antigens that are characteristic for a population that has recovered from an infection with the pathogen without drug intervention. In less preferred aspects, the sequences according to SEQ ID NO:1 to SEQ ID NO:1150 may also be employed as DNA vaccines, or be part of an in vivo expression system that triggers an immune response against the in vivo produced recombinant antigen or fragment thereof.

With respect to suitable formulations of vaccines, it should be recognized that all known manners of producing such vaccines are deemed appropriate for use herein, and a person of ordinary skill in the art will be readily able to produce such vaccines without undue experimentation (see e.g., "Vaccine Adjuvants and Delivery Systems" by Manmohan Singh; Wiley-Interscience (Jun. 29, 2007), ISBN: 0471739073; or "Vaccine Protocols" (Methods in Molecular Medicine) by Andrew Robinson, Martin P. Cranage, and Michael J. Hudson; Humana Press; 2 edition (Aug. 27, 2003); ISBN: 1588291405). Therefore, suitable vaccines may be formulated as injectable solutions, or suspensions, intranasal formulations, or as oral formulations.

Examples

The following examples are provided for *Plasmodium falciparum* (Pf) and, in part, also for Vaccinia virus as target organism. Substantially similar protocols were adapted to identify immunodominant antigens from *Burkholderia pseudomallei, Borrelia burgdorferi, Brucella melitensis, Chlamydia muridarum, Coxiella burnetii, Francisella tulare*, Herpes virus 1 and 2, and *Mycobacterium tuberculosis*.

Genes/ORFs for Pf were selected in silico and associated (where known) with various specific criteria, including pattern of stage-specific gene or protein expression deduced from genomic, proteomic, or cell biology datasets. PCR primers were then computed to allow for amplification, cloning, and expression as further outlined below. So selected genes/ORFs were then amplified cloned using a high throughput PCR cloning method as previously described by the inventors (Genome Res 14, 2076-2082 (2004)). Efficiencies of the overall process of PCR amplification and cloning were typically about 90% (with higher values for smaller genes and lower values for larger [>2 kBp] genes). A subset of the amplified and cloned genes were sequenced to confirm the identity of the target gene and to verify that mutations were not introduced as a result of the amplification and cloning process. On average, 97% sequence identity was noted.

As compared with other organisms, Pf proteins have often been difficult to express by conventional methodologies in bacterial, yeast or insect expression systems. The inventors therefore evaluated the efficiency of Pf protein expression in an *E. coli* based cell-free in vitro transcription/translation system (RTS100, commercially available from Roche Biosciences) using 295 different cloned and HIS-tagged Pf ORFs as templates. Quantification of the signal intensities revealed that 94% of signals were ≥4× the controls. A replicate HA-tagged Pf array was produced with two sets of Pf vectors, containing a stop codon either before or after the HA tag. Such tagged recombinant proteins allow facile identification, rough quantification, and purification where desired. Uniformly high expression efficiencies >90% were obtained in all cases. Remarkably, the amount of protein printed per chip is essentially at saturation (data not presented), meaning that differences between any detected antigen reactivities would not be due to differences in the amount of protein spotted.

PCR amplified and cloned genes/ORFs were expressed in the RTS100 cell-free in vitro transcription/translation system, and printed in duplicate onto microarray chips. These chips were probed with sera from a population of subjects (n=12) who were naturally exposed to malaria in a hyperendemic region of Kenya, a population of subjects (n=10) who were experimentally immunized with radiation attenuated Pf sporozoites and either protected (n=6) or not protected (n=4) against challenge with infectious sporozoites, or a population of malaria-naïve individuals.

Most notably, sera from malaria exposed individuals and sporozoite immunized subjects reacted against different subsets of expressed proteins. For the naturally exposed group, there were 156 antigens with p values<1e-3 and 77 antigens with p values<1e-7 while for the pre-challenge sera from the irradiated sporozoite immunized groups, there were 17 antigens with p values<1e-3 in the protected group and nine antigens in the unprotected group. The low p values indicate that the signals obtained from the chip are highly significant. Background reactivity from naïve donors was low (data not presented).

A similar panel was prepared for vaccinia virus with primary and secondary exposure and with a variola as a control group. The results of this series of experiments can be taken from the summary panel of FIG. 1, in which the different populations provided different targets for different types of antibodies. Here, a proteome-wide view is provided for the serological response to DryVax vaccinia and smallpox. Protein microarrays displaying 210 different vaccinia strain WR proteins were probed with sera from individuals before, and 28-30 days after, primary or secondary vaccination with DryVax. All signal intensities have been background subtracted of control spots that lack template DNA, and assigned a color, with the dark end of the spectrum representing the highest signals. At the low end of the scale, a signal intensity of 5000 has been used as the cut-off above which a response was considered positive. Thus all negative responses are light. No significant reactivity was seen with any of the secondary antibodies alone (not shown). The combined IgG, IgM and IgA profiles in primary and secondary DryVax infections include 64 and 49 different antigens (~29% and ~22% of the proteome), respectively. Interestingly, most antigens are recognized by fewer than half the vaccinees, and late antigens dominate both primary and secondary responses. Despite variola being a different orthopox species, antibody profiles of individuals infected with smallpox are essentially indistinguishable from DryVax or VIG profiles.

As can be taken from FIG. 2, the antibody profiles between individuals responding to the DryVax are heterogeneous to a significant degree. Each protein in the proteome was scored seropositive if its signal intensity was >5000 after subtraction of its signal intensity seen with pre-immune serum. As is readily apparent, there were relatively few antigens that were frequently recognized. Indeed, most positive antigens were recognized by fewer than half the vaccinees, reflecting the heterogeneity of individual profiles, and with that reflecting the difficulty in traditional vaccine development to obtain a vaccine that is effective for a large fraction of a population. FIGS. 3A and 3B depict immunodominance profiles of vaccinia antigens in human primary and secondary responses. Average signal intensities from sera 28-30 days post vaccination, with corresponding pre-vaccination signals, were plotted as raw data. Primary responses are shown in panel (A) and secondary responses are in panel (B). In each panel, a cut-off, indicated by the horizontal line, was set by the average of 7 pairs of control spots (expression reactions lacking DNA template) plus 2 standard deviations. The relatively large standard deviations are due to the inter-individual heterogeneity. Pre and post responses to an antigen that are significantly different by 2-tailed, paired t-test are indicated as * $p<0.0005$,  $p<0.005$, * $p<0.05$. Others were considered non-significant.

Characteristic profiles of antigen reactivity were noted for each of the clinically distinct cohorts, indicating that immunoreactive antigens identified in this way may be useful for serodiagnostic tests that are not only relevant with respect to the observed reactivity, but also with respect to a disease parameter (e.g., previous exposure to the pathogen, duration of exposure to the pathogen, chronic infection, at least partial immunity to infection with the pathogen, expected positive outcome upon treatment, etc.). Remarkably, and with regard to the Pf immune panel, the naturally exposed cohort who was protected against clinical disease, but not Pf parasitemia, gave an entirely different immunoreactivity profile compared with the sporozoite-vaccinated cohort that has both anti-disease and anti-parasite immunity. Further, naturally exposed subjects reacted more strongly to a larger number of antigens than the sporozoite immunized subjects, and the subset of sporozoite vaccinees that were protected reacted more strongly to a larger number of antigens than the unprotected group. Still further, the antigen repertoire in the sporozoite immunized and protected group immediately prior to challenge was unchanged after challenge. In contrast, immunized volunteers who developed clinical malaria following experimental challenged (experimentally infected) developed an additional subset of antibodies after challenge; many were similar to the naturally exposed profile but some were unique to the experimentally infected group.

In addition to the subset of antigens identified on the basis of intensity of response, a subset of antigens which were less immunoreactive but nonetheless frequently recognized was identified. For example, for naturally Pf exposed subjects, 121 antigens were recognized at $p<0.05$ and frequency≥50% regardless of signal intensity; 20 antigens were recognized by 12/12 subjects (11/20 at signal intensities<4.0). For irradiated sporozoite immunized subjects 82 antigens were recognized pre-challenge at $p<0.05$ and frequency≥50% by both protected and unprotected subjects; five antigens were recognized by 10/10 subjects (2/5 at signal intensities<4.0). It is therefore contemplated that antigens recognized in high frequency but not necessarily at high magnitude may represent good diagnostic targets.

Figure 4:
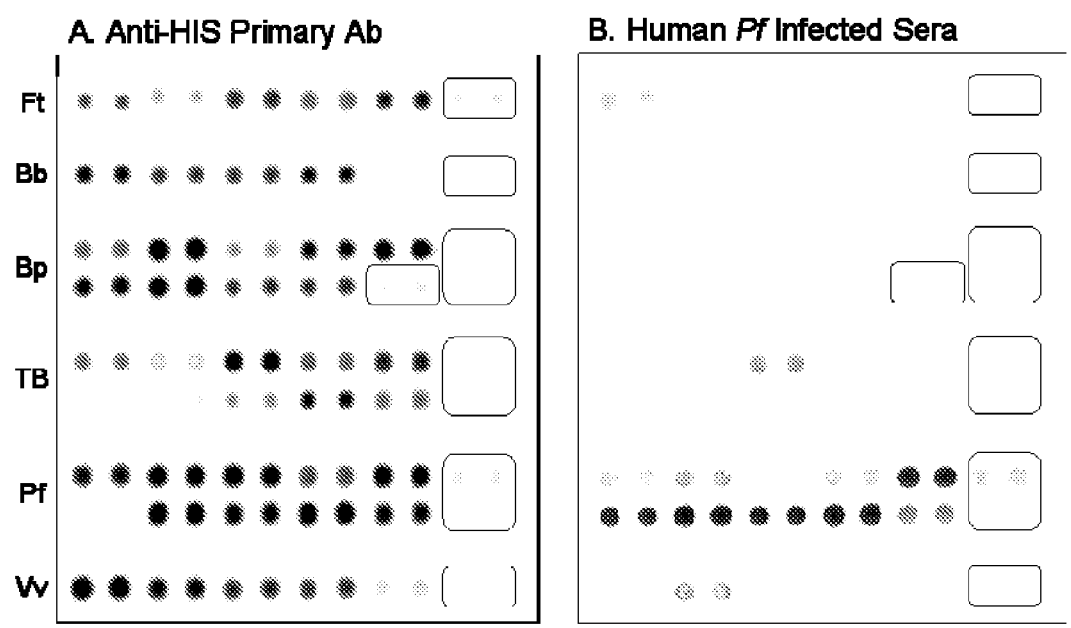
FIGS. 4A and 4B are exemplary scans of diagnostic arrays comprising multiple immunodominant antigens of multiple distinct pathogens depicting approximate quantities of antigens deposited (A) and their reaction against human serum of a patient infected with a pathogen.

To illustrate how immunodominant antigen sets identified in this way can be used for serodiagnostics, a protein microarray containing immunodominant antigens from several infectious agents was fabricated. The antigens were expressed in the cell-free in vitro transcription/translation system, printed onto FAST slides without further purification, and probed with anti-histidine primary antibody followed by alkaline phosphatase conjugated secondary antibody. The slide was developed with alkaline phosphatase substrate and scanned using an ordinary desktop document scanner. The result of this scan is illustrated in FIG. 4 (A) depicting the 'antigen-loading' of the array. Immunodominant antigens represented on this 'diagnostic chip' are derived from: *F. tularensis* (Ft), *B. pseudomallei* (Bp), *B. burgdorferi* (Bb), *M. tuberculosis* (TB), *P. falciparum* (Pf) and vaccinia virus (Vv). The negative control spots (within circles) correspond to in vitro expression reactions without plasmid template. An example of the same slide probed with serum from one of the Kenyan subjects naturally exposed to Pf is shown in FIG. 4 (B). The strongest signals were against the Pf immunodominant antigen set, with weak reactivity toward vaccinia virus and *M. tuberculosis* antigens. Reactivity against non-Pf antigens could be a consequence of prior exposure to these infectious agents or to cross-reactivity.

The following exemplary protocol is provided to illustrate the steps and reagents used in the identification of the immunodominant antigens of Pf presented herein. Unless expressly stated, standard laboratory techniques well known to a person of ordinary skill in the art were employed.

PCR Amplification of Linear Acceptor Vector

Plasmid pXT7 (10 µg; 3.2 kb, KanR) was linearized with BamHI (0.1 µg/µl DNA/0.1 mg/ml BSA/0.2 units/µl BamHI; 37° C. for 4 hr; additional BamHI was added to 0.4 units/µl at 37° C. overnight). The digest was purified using a PCR purification kit (Qiagen, Valencia, Calif.), quantified by fluorometry using Picogreen (Molecular Probes, Carlsbad, Calif.) according to the manufacturer's instructions, and verified by agarose gel electrophoresis (1 µg). One ng of this material was used to generate the linear acceptor vector in a 50-µl PCR using 0.5 µM each of primers 5'-CTACCCATACGATGTTC-CGGATTAC (SEQ ID NO:1151) and 5'-CTCGAGCATAT- GCTTGTCGTCGTCG (SEQ ID NO:1152), and 0.02 units/ µl Taq DNA polymerase (Fisher Scientific, buffer A)/0.1 mg/ml gelatin (Porcine, Bloom 300; Sigma, G-1890)/0.2 mM each dNTP with the following conditions: initial denaturation of 95° C. for 5 min; 30 cycles of 95° C. for 0.5 min, 50° C. for 0.5 min, and 72° C. for 3.5 min; and a final extension of 72° C. for 10 min.

PCR Amplification of ORF Insert

A total of 1-10 ng of Pf genomic DNA (3D7 strain) was used as template in a 50-µl PCR. The following primers were used (0.5 µM each): 5'-CATATCGACGACGACGACAAG-CATATGCTCGAG (SEQ ID NO:1153; 20-mer ORF specific at the 5' end) and 5'-ATCTTAAGCGTAATCCGGAA-CATCGTATGGGTA (SEQ ID NO:1154; 20-mer ORF specific at the 3' end). The Pf genome is the most A+T rich genome sequenced to date with an overall (A+T) composition of 80.6%, rising to ~90% in introns and intergenic regions. Consequently, PCR amplification of Pf genes using genomic DNA template was problematic. Initially, PCR was carried out using regular Taq DNA polymerase: 0.02 units/µl TaqDNA polymerase (buffer A, Fisher Scientific)/0.1 mg/ml gelatin (Bloom 300, Porcine; G-1890, Sigma)/0.2 mM each dNTP. Conditions were as follows: initial denaturation of 95° C. for 5 min; 30 cycles of 20 sec at 95° C., 30 sec at 50° C., and 60 sec/kb at 72° C. (1-3 min on average, based on ORF size); and a final extension of 72° C. for 10 min. PCR products that were more difficult to produce were reamplified by using a 30 sec annealing time at 45° C. or 40° C., instead of 30 sec at 50° C. Also, the extension temperature was decreased from 65-72° C. to 50° C. Subsequently PCR products were obtained using a Taq polymerase with improved proof-reading characteristics (Triplemaster from Eppendorf), increasing the efficiency of the PCR step to 87%: 0.04 units/µl Triple Master PCR system (high-fidelity buffer, Eppendorf)/0.4 mM each dNTP (Eppendorf). Conditions were as follows: initial denaturation of 95° C. for 3 min; 35 cycles of 15 sec at 95° C., 30 sec at 40° C., and 60 sec/kb at 50° C. (1-3 min on average, based on ORF size); and a final extension of 50° C. for 10 min., PCR products that were difficult were reamplified using 50 ng genomic DNA. The PCR product was visualized by agarose gel electrophoresis (3 µl). For quantification, the product was purified (PCR purification kit, Qiagen) and quantified by fluorometry. Since the reliability of producing the desired PCR product decreases as the length of the genomic DNA fragment increases, exons longer than 3,000 bp were divided into multiple overlapping sections, with 50 nucleotide overlaps.

In Vivo Recombination Cloning

Competent cells were prepared in our laboratory by growing DH5a cells at 18° C. in 500 ml of SOB (super optimal broth) medium (2% tryptone/0.5% yeast extract/10 mM NaCl/2.5 mM KCl/20 mM MgSO$_4$) to an OD of 0.5-0.7. The cells were washed and suspended in 10 ml of pre-chilled PCKMS buffer (10 mM Pipes/15 mM CaCl$_2$/250 mM KCl/55 mM MnCl$_2$/5% sucrose, pH 6.7) on ice, and 735 µl of DMSO was added dropwise with constant swirling. The competent cells were frozen on dry ice-ethanol in 100-µl aliquots and stored at −80° C. Each transformation consisted of the following: 10 µl of competent DH5α and 10 µl of DNA mixture (40 ng of PCR-generated linear vector/10 ng of PCR-generated ORF fragment; molar ratio, 1:1; vector, 1-kb ORF fragment). For transformation, the purification of PCR product was unnecessary. The mixture was incubated on ice for 45 min, heat shocked at 42° C. for 1 min, and chilled on ice for 1 min; mixed with 250 µl of SOC (super optimal catabolizer) medium (2% tryptone/0.55% yeast extract/10 mM NaCl/10 mM KCl/10 mM MgCl$_2$/10 mM MgSO$_4$/20 mM glucose); incubated at 37° C. for 1 hr; diluted into 3 ml of LB medium supplemented with 50 µg of kanamycin per ml (LB Kan 50); and incubated with shaking overnight. The plasmid was isolated and purified from this culture, without colony selection.

In Vitro Protein Expression

Plasmid templates used for in vitro transcription/translation were prepared by using QIAprep Spin Miniprep kits (Qiagen), including the "optional" step, which contains protein denaturants to deplete RNase activity. In vitro transcription/translation reactions (RTS 100 *Escherichia coli* HY kits; Roche) were set up in 25 µl PCR 12-well strip tubes and incubated for 5 h at 30° C., according to the manufacturer's instructions.

Immuno-Dot Blots

To assess relative efficiency of protein expression, 0.3 µl of whole rapid-translation system (RTS) reactions were spotted manually onto nitrocellulose and allowed to air dry before blocking in 5% nonfat milk powder in TBS containing 0.05% Tween 20. Blots were probed with hyperimmune sera diluted to 1:1,000 in blocking buffer with or without 10% *E. coli lysate*. Routinely, dot blots were stained with both mouse anti-poly-HIS mAb (clone, HIS-1; H-1029, Sigma) and rat anti-hemagglutinin (HA) mAb (clone, 3F10; 1 867 423, Roche), followed by alkaline phosphatase-conjugated goat anti-mouse IgG (H+L) (BioRad) or goat anti-rat IgG (H+L) (Jackson ImmunoResearch) secondary Abs, respectively. Bound human Abs were visualized with nitroblue tetrazolium (nitro-BT) developer to confirm the presence of recombinant protein.

Microarray Chip Printing

For microarrays, 10 µl of 0.125% Tween 20 was mixed with 15 µl of RTS reaction (to a final concentration of 0.05% Tween 20), and 15-µl volumes were transferred to 384-well plates. The plates were centrifuged at 1,600×g to pellet any precipitate, and supernatant was printed without further purification onto nitrocellulose-coated FAST glass slides (Schleicher & Schuell) by using an OmniGrid 100 microarray printer (Genomic Solutions, Ann Arbor, Mich.). All ORFs were spotted in duplicate to enable statistical analysis of the data. Data values reported herein represent the average of pairs. In addition, each chip contained an area printed with controls consisting of RTS reaction using no DNA.

Protein Microarray Screening

Microarray chips were probed with human serum that was first pre-absorbed against *E. coli-lysate* to block anti-*E. coli* antibodies as described previously. In the absence of pre-absorbing, high titers of anti-*E. coli* antibodies could mask any antigen-specific responses when using whole RTS reactions on dot blots and arrays. For all staining, slides were first blocked for 30 min in protein array-blocking buffer (Schleicher & Schuell) and then incubated in serum for 2 hr, at room temperature. Antibodies were visualized with Cy3-conjugated secondary Abs (biotinylated secondary followed by Streptavidin PBXL-3, for HIS-probing) (Jackson ImmunoResearch) and scanned in a ScanArray 4000 laser confocal scanner (GSI Lumonics, Billerica, Mass.). Fluorescence intensities were quantified by using QuantArray software (GSI Lumonics). Other studies in our affiliated University laboratory have established that the results from scanned microarray chips can be represented numerically and that signal intensity is proportional to antibody titer (data not shown).

ELISA

To validate the immunoreactivity detected by the protein microarrays, sera was analyzed by ELISA against a panel of known and well-characterized Pf pre-erythrocytic stage antigens (PfCSP, PfLSA1, and PfExp1) and erythrocytic stage antigens (PfAMA1, PfMSP1), as previously described. The mean OD readings of quadruplicate assays were recorded, and results reported as the OD value at each serum dilution and as endpoint dilution (defined as greater than the mean+/−3 standard deviation of negative control sera).

Indirect Fluorescent Antibody Test (IFAT)

Antibody recognition of Pf (NF54/3D7) sporozoite or blood stage parasites was evaluated by IFAT as described previously. Reactivity was scored as positive when the immunofluorescence pattern of the parasite was recognized and when the fluorescence was above the background of the negative controls. IFAT results were expressed as the endpoint serum dilution at which positive fluorescence was detected.

Malaria-Exposed Study Populations

Individuals were selected for study on the basis of malaria history. Studies were conducted in compliance with all applicable Federal regulations governing the protection of human subjects. The irradiated sporozoite study protocol was approved by the Naval Medical Research Center Committee for the Protection of Human Subjects, the Office of the Special Assistant for Human Subject Protections at the Naval Bureau of Medicine and Surgery, and the Human Subjects Research Review Board of the Army Surgeon General. The Kenyan samples were collected under a study protocol approved by the Naval Medical Research Institute's Committee for the Protection of Human Subjects, the Walter Reed Army Institute of Research Human Use Committee, and the Kenya Medical Research Institute/National Ethical Review Committee. Written informed consent was obtained from all subjects.

Sporozoite Immunized Volunteers

Caucasian volunteers (n=10) were experimentally immunized with radiation-attenuated Pf sporozoites as previously described (The Journal of Infectious Diseases (2002), Vol: 185, p1155-64). Subjects were challenged by the bites of 5 infected Anopheline mosquitoes, and evaluated for the development of clinical malaria. Protection was defined as complete absence of blood-stage parasitemia (sterile protection). Six of the 10 immunized volunteers were protected against sporozoite challenge and were classified as sporozoite-immune; four were not protected and were classified as sporozoite-exposed but non-immune.

Serum samples were collected from each volunteer prior to immunization (pre-bleed), at the completion of the immunization series and immediately prior to challenge (pre-challenge), and following challenge (post-challenge). Pre- and post-challenge IFAT titers against Pf sporozoites were 613.3 (mean; range 160-1280) and 170 (mean; range 40-320) for protected and unprotected volunteers, respectively.

Individuals Naturally Exposed to Malaria

Kenyan subjects (n=12) were residents of the Asembo Bay area of Kenya. In this area, the year round prevalence of Pf infection amongst children 6 months to 6 years of age has been documented as 94.4-97.8%. Enrolled subjects reported an average of 2.1 episodes of clinical malaria within the previous year. The study cohort derives from a subset of 185 volunteers previously enrolled in an immunoepidemiology study and selected for the current study on the basis of sex, age, malaria history and recognition of native Pf sporozoites and parasitized erythrocytes, by IFAT. Pf sporozoite and blood-stage IFAT titers for the pool of hyperimmune sera from these 185 individuals were 5,120 and 81,920, respectively.

Analysis of Individual Array Measurements

As a first step in determining significantly bound antigens for each serum/array using statistical tests, the inventors defined the true negative control signal to compare each antigen with the mean signal of all spotted controls on the array. Since comparisons needed to be carried across arrays, the inventors transformed the raw signals using the vsn (asinh transformation, similar to log for higher intensities) method, shown to effectively calibrate array measurements through shifting and scaling and also to stabilize the variance in DNA microarray and 2D difference gel electrophoresis data analyses. Because standard deviation (SD) estimates can be unreliable (artificially high or low) when there is low replication of measurements, and since each antigen was spotted only twice per array, the inventors applied the Bayes-regularization technique described in Baldi and Long (Bioinformatics (2001), 17, 509-519; Baldi, P. and Hatfield, G. W. (2002) DNA Microarrays and Gene Expression: From Experiments to Data Analysis and Modeling, Cambridge University Press, Cambridge, UK; and Bioinformatics (2006), Vol. 22, No. 14; p:1760-1766, all incorporated by reference herein). This technique derives more robust estimates (as shown in the context of DNA microarray data analysis) of the SD of each antigen as a weighted combination of the sample SD and the pooled SD of neighboring antigens with similar signal intensity. Using these new regularized estimates for the standard deviation, we conducted a series of Bayes-regularized one-sided t-tests on antigens with higher mean signal than the defined control to reliably estimate the signal changes between each antigen and control, and computed the corresponding p-values.

Analysis of Groups of Array Measurements

In addition to determining the positive antigens recognized by each of the individual sera, the inventors averaged replicated spot measurements per sera and pooled the responses for each cohort/group, to identify the positive antigens while taking into account the biological variation within the sera in each group. Since the measurements were obtained from different arrays, the inventors performed a calibration and variance stabilization of the measurements using the vsn method (Bioinformatics 18 Suppl 1, S96-104 (2002) prior to the pooling of measurements. As for the analysis of individual sera, the inventors defined the true negative control using the mean control signal spotted on the arrays. One-sided Bayes-regularized t-tests were performed within each group to compare and rank the antigens with a higher mean signal than the control. For the individual and cohort/group analysis, using the average SD of 5-30 neighboring antigens along with a weight of 5 "pseudocounts" for computing the Bayes-regularized SD was observed to achieve a moderate regularization effect. Given the large number of hypotheses being tested, the inventors applied the method in Storey and Allison et. al. to the set of p-values to estimate the experiment-wide false discovery rates (FDR). For the individual and cohort analyses of the 43 arrays, a p-value cutoff of 0.05 corresponded to an FDR level of 0.06-0.065. With the additional criteria applied for determining a positive response as described below, the inventors expect the FDR to be lower.

Analysis of Frequency of Response

In addition to analyzing the intensity of response (as described above), the inventors also assessed the frequency of response for each antigen as the number of individuals within a given cohort for which that antigen was positive on the basis of normalized signal intensity relative to control.

Criteria of Positivity (Immunodominance)

Final classification of antigen reactivity was made taking into account both magnitude of response (signal intensity) and frequency of recognition. The responses by a particular cohort of donors were considered positive overall if all of the following criteria were met: (1) normalized signal intensity >4.0 (ratio of signal intensity of test relative to control >4.0); (2) response was statistically significant ($p<0.05$) compared with control signal intensity; and (3) frequency of positive responses within a particular cohort ≥2.0.

Thus, specific embodiments and applications of immunodominant compositions and methods have been disclosed. It should be apparent, however, to those skilled in the art that many more modifications besides those already described are possible without departing from the inventive concepts herein. The inventive subject matter, therefore, is not to be restricted except in the spirit of the appended claims. Moreover, in interpreting both the specification and the claims, all terms should be interpreted in the broadest possible manner consistent with the context. In particular, the terms "comprises" and "comprising" should be interpreted as referring to elements, components, or steps in a non-exclusive manner, indicating that the referenced elements, components, or steps may be present, or utilized, or combined with other elements, components, or steps that are not expressly referenced. Furthermore, where a definition or use of a term in a reference, which is incorporated by reference herein is inconsistent or contrary to the definition of that term provided herein, the definition of that term provided herein applies and the definition of that term in the reference does not apply.

Sequence Listing

The Sequence Listing providing sequences with the SEQ ID NO:1 to SEQ ID NO:1150 is submitted as a single file on a single compact disc in computer readable format (CRF; three copies of the disc were submitted together with the original CRF disc), wherein the single file is entitled "101519.0001PCT_Sequence_Listing_ST25.txt", which was created Oct. 25, 2007, which has a size of 1908 kb, and which is incorporated by reference herein. Therefore, four identical discs, each containing a single sequence listing file with the file name "101519.0001PCT_Sequence_Listing_ST25.txt" have been submitted.

SEQUENCE LISTING (1154 sequences)

SEQ ID NO: 1 - DNA, 1002 bp, Chlamydia Muridarum
atgacaagacttcctctactcaaacgacctcgaagaaatcggaaaagtgctgctattcgatctatgattcgagaaactaatatggtttcaagtgatctaatttggcctatttttcttaaagaaggttcaggaattcgagaagaaatacccagtatgcctggagtatacagatggagtttagataccatatctagagaattagaaagactctgtcttatagggctaaaagcggttatccttttccctgttatagaggatcagaaaaaagatcaattcggagcatatgcatcgcatccgtataacattgtttgtagaggaattcaggaaatcaaaaaatcttttccccaactgtgtgtgattagtgatatagctttagatccttttacgactagtggtcacgatggcattttttacaacaatgaagtgttaaatgacgaaagcgttcgcgtatatggagatatcgcaacattgcatgcagaaatgggagcggatattgttgctccaagcgatatgatggatgggagagttcggcatattcgagaaaaaatggatcagatgggctttgttaatacaggaattctctcttatagcgcaaagtatgcatcttacttgtatggtccgtttagagatgctctttcttcgcatcctcaatctggggataaacggcaatatcaaatggatcctgccaatgttcgagaagctttgcttgaatgccggctagatgaagaggagggagcagatatggtaatgataaagcctgctgggttttatttagatgttatcatgaaagctcaagaatgtacgcatcttccagtagttgcctatcaagtcagtggagaatattctatgattatggccgccagtctgcatggatggttaagtaaagaaggagctatctcggagtctttgttagcaattaaacgagctggggctacggctataattagctatgcaactccatgggttttagaatggctagctagagacgctcttcctttttaa

SEQ ID NO: 2 - DNA, 237 bp, Chlamydia Muridarum
atgaaagagtttttagcgtacattgtaaaaaatcttgttgataggccggaggaagtgcatctaaaagaggtgcagggaacgaacacgattatctacgaattgactgttgctaagggagatatcggtaaaatcatcgggaaggaaggacgaacgatcaaagcaattcgtaccttgcttgtctccgtagcaagccgagataatgtgaaggtcagtctagaaattatggaagagcgataa

SEQ ID NO: 3 - DNA, 2475 bp, Chlamydia Muridarum
atgggtatacgcttagttgttgataaagggcccttgtctggaaccgtccttattttggaaaacgggacgagttggtctcttggaagtgacggcaaagcaagcgatattttattgcaagatgaaaagcttgctcctgctcaagttcgcgttactttaaaagatggcgaatattacctagaaaatttagatgtttctcggccagtcctggttaatggagtcgctattacagctccgaccctattaaaagagggaattcccttcgtaatgggaagctgcgagtggtcattttttaaaggagaagaagtagaaggagatatcgagttatcgttccagacagaagaaaacggcggagaagcggaacagcaagcgcaaggatcttctcaagttgaatcaaaaacgaacacaggacctcgaggccattcttcaggagcttcgtctgcagacggagtttcagcttctgcagcagaaaaagaacaaaagttagcggaatcctttttagcttctgttgagaaggggacaggagctgtacaagaagactctaatagagaagtctctttgcaggaaaatcaacaagctgctcccgcaaaagagaaaatgaatctcgagcttccttcagtaaatcaagaacaaccaaaacaagctactccatcaggcagtggtgaactaactcaatctcaaaacgtgagtatggaagaaaacagaccatcacccgatcaaaatcagcagcctcagctttcttctgattcggaaccagatgctaaaggtgctgagaatcaagagcaactttcacaatcttcttctccatctcaggaaaatccgaaacaatcagaagattccagtagcgctacaaaagaaagtgttgcaactccggaagagaaactcccagaggcggaaggagacaattctgcatcgagcgaggaagaaaagattgaagaagaatcttccgaaggagaatctaatgaggagcaaacggtagaagctcctgcagaagaagagaaaaaagaagaaaaaggagaggttctagcgcctttcaatgtgcaggatcttttccgatttgatcaaggtattttccctgcagagatagaagatcttgcacaaaaacaagttgctgtagatctcactcagccttctcggtttttattaaaagtacttgctggggctaatattggtgctgagtttcatttggatagcgggagaagctatatagtcggaagtgatcctcaggttgctgatattgttctaagtgatatgagcatttctcgccaacatgcgaaaattattattggcaatgatagctctgttctcattgaagatttaggcagtaagaatggcgtgattgttgaaggccggaagatagagcatcagtctactctttccgccaaccaagttgttgctctaggaacaacattgttcttacttgttgattacgcagctccttctgacacagtaatggctaccatttcttctgaagattacgggttgtttggtcgtccgcaatctccagaagaaattgctgcaagaaaagaggaagaggaagaagagaaaagaaagcgggcaacattaccaacaggcgcttttattttgaccctatttgtaggaggtctagcactcctttttggaataggaacagcttctctattccatacgaaagaagtagtttctatcgatcaagtagatttaattcatgatattgagcatgtgattcaacagtttccaactgtacggtttacctttaataagaataacgggcagttattcttaattggtcacgtaaaaaatagcatcgataagagtgaattgctttataaggtagatgccttgccttttgtcaaatctgttgatgataacgtgattgatgatgaggctgtatggcaagaaatgaatattttgctctccaagaagcctgagtttaaagggatcagcatgctgtctccagagccaggagtttttgttatcagtgggtacttgaagacagaagagcaagcggcatgtctgtcagattacttaaacttacactttaattatctttcgctattggacaataaggttgttatagaaacgcaggtaatcaaagcgcttgcagggcatttgatacagtctggtttcgcaaacgtccatgttgcttttaccaatggtgaagctgttttgactgggtacattaacaataaagatgcggataagttccgagcagttgtgcaagagcttcaagacattgctgggattcgcgtggtaaagaattttgttgttttgttgcctgcagaagagggtgttattgatctgaatatgcggtatccagggcgttatcgggtaacaggtttttctaaatgcggagatattagcatcaatgttgtagtgaatgggcgtattttgacccgaggcgatgttttagatggaatgacagtaacaagcattcaaccacacagtatctttttagaacgcgaagggttgaaatataaaattgagtacaataaatag

SEQ ID NO: 4 - DNA, 1329 bp, Chlamydia muridarum
atgaaagagctaacgaccgagtttgatacgctcatgactgaattgccagaagttcaattgacggcagttgttgggcgtattatcgaagttgtcgggatgttaatcaaagctgtcgttccggatgttcgggtgggcgaagtttgcctggtgaaacgtcatggaatggagcctttggtaacagaggttgtcgggtttacgcagaactttgtatttctctctcctttaggagagttatctggagtgagtccttcttctgaagtgatcgccacgggattgcctttgcacattcgagcaggggcaggacttttaggccgtgtattgaatggtcttggagaacctattgatatagagaccaaaggacctttggagaatgtcgattccatttatcccatttttaaagctccaccagatcctttgcatcgagaaaaattgcgtacgattctatctacaggagtgcgttgtatagatggaatgcttactgttgccaaaggacaaagaatcgggatttttgcgggagcaggggtcggaaaatcttctttgttaggcatgattgctcgtaacgcagaagaagccgatattaacgtgattgcgttaattggagagcggggacgagaagttcgggagtttatagaaaatgaccttggtgaagaaggaatgaaacgttccgtcattgtggtatctacttccgatcaatcttctcagcttcgattgaacgctgcttatgtgggaacagctatagcagaatattttagggaccagggtaagacagttgtgcttatgatggattctgtgacccggtttgctcgagctttacgggaagtagggctcgcagctggagagcctcctgctcgtgctgggtatactccttccgtattttcaacattgcccaaattattggaaagagcgggagcttcggagaaagggactatcacggcattttataccgtgttagttgctggggatgatatgaatgagccggtggctgatgaggtgaagtctattttggatgggcatatcgtgctttccaacgcgttagctcaagcttatcattatcctgcgattgatgtgctggcttctattagccgattattgactgcaattgttcctgaagaacaacgtcgaattattggtcgtgctagggaagtcttagcgaaatataaagcgaacgagatgttgattcgtattggggaatatcgtcgagggtctgatcgtgaggtagatttcgcgattgaccatattgataaattgaatcgtttcctcaagcaagatattcatgaaaaaacaaattatgaggaagctgctcagcagttgagagcaatattccggtaa

SEQ ID NO: 5 - DNA, 852 bp, Chlamydia muridarum
atggaagtaaataaaacgacagaatctttgtttagtgcaaaggttgagcataatcatgcacaggcagaatctcatgagccaagagatcaaagagatgttaaggtattttctttaggaggaaaatcttcctctaaacaagaaaaattagaccatggatcaggaagaacctcttcgcgtcatgaaacttcaagaagttctaaggaaggtagtattgaagataagtctgcagaagtttcttctcgagaagaagaggaggaaaacagagatggattcttgtctggaggtaatttaactgcaggagtagcttttactgatacacctatggctgtagctagcgaagtgatgatagagaccaatgctgtgaccatgagtcaaattgatttgcaatgggtagaacagcttgttttatctacagtagaatccttgttagttgctgatgtagatggaaagcaattagtagagattgttttagataataatagtacagtgccagaggctttctgcggagctaatttaaccctagtgcaaacaggggaggatgtggctgttactttctcaaatttcgtagatcaggatcaggttgcagaagctatgcaactggttcaacagaatcccgagcaattaacttctttagttgagtctttgaagtctcgtcagttaaatttaacagagttagttgtaggtaacgtagccgttagcctacctgttcttgaaaaagtagaaactccattacacatgattgcagcgactattcgtcatcatgatcaggaaggagaccaagaaggtgaaggacgtcaagaacaacatcaaggtcgccagcaagagaagaaattagaagaagctcagatataa

SEQ ID NO: 6 - DNA, 1122 bp, Chlamydia muridarum
atggcagttgcagcagagcctagtagtaattggttgaaagctagagacgagttactaagttctttgcaaaaacaggacgaagggagtttctcccttcctgttttcccaaagcaggagtgtgagcagaaactgaaagagaaattccacttagaagaggtggaactctcttttgagtcgcaagggctcttgtctgctgcacctgctgtgcaggaatacggagagcatgttttgcttcagccatttttggcaaatccctttgaatcaggagagttttatattgtttcttcagaagaagatttgcaagcattgatagggaccatttttaatgatagttccctagcttcttacttctatgaaaaagatcggttattggggttccattactattttgttgccgagatctgcaagcttttgcaagaggtctcttggatcccttccatggcagtgaaggtaacaggggatgttgcattttctgctcgtgctttagaaggggactatcatgttgtgcaagtcacttgtcgtttagatagctcttatgtgcgtttttctgttttggttcctgacacaacagcccagagtgtctataaattcttagaagagaagaatcagactttcgatatccaaaaaatcgatatgcaaactcctgttactctctctgtagaagtagggttttgtcagatctcagaagaagattggcaccaagttgttcccggcagttttattttgttagatgcttgtttgtatgatccagatacgggcgatgcgggagctttcttatcgattcagcgtactcggttttttggtggacggtttttagacaagcagtcgggagattttaaaattactggattgcaagaacttcagccagaagatgctcctgaggaacacagcgaaggaggcccagcagctcctttaccatccgcgacaaaaattgttgcagaggttgctcgctatactctttctgttggagaatttttgaagctagaacccggaagcattttgcattttgaaggcatgcatcctactttaggggtagatatcattctgaacggggctaaagtgggtcgtggcaatattattgctctgcaagatgtgctaggaattcgagttttagaagtataa

SEQ ID NO: 7 - DNA, 2019 bp, Chlamydia muridarum
ttgaacaagaattctcttacttgtcaggatttgaaagaagttggctataccgtcaattttgaagacatttctattttggaattgctgcagtttgtaagtaagatttccggaacaaatttcgtttttgatagcaatgacttgcaattcaatgtaacgatagtttctcacgatcctacttcggtggatgatttagcaacgattctattgcaagttttgaagatgcatgacttgaaagtcatggagcaggggaataacgtattaatttatcgcaatccgaagctttcacaactgtcaacagtagtgactgatggctctgccaaagatactagtgaagcagtagtggttacacgagtatttcgtttgtatagcgtaagtccttctgctgcggtagaaattattcagccgttactttcccatgatgcgattattagtgcttccgagtccactagacatattatcgtttcggatatagcaggaaatatcgaaaaagttcgagagttgatacaggcattagatagccctggagcgtctattgatatgtctgagtatgaagtgcagtttgctaatcctgctgcattagttagctattgtcaggatgtccttggagcaatgacggaagaagagggcttccaaatttttattcagccagggacgaataaaatttttgttatttcatctccaagattaacaacgaaagcgatccaattattacaatctttagatatcccagaaatggcgcatacattggatgatgtgacgagccctgcgtctgctttgggtagctctggatccgctaatcctaagagcatgcgctttttcatgtataaattgaaatatcaggatggatcagctattgctcaagcgatccaggatattgggtataacctttatgtgacaacggcgatggatgaagatttcatcaacacgttgaacacgattcaatggttgcctattaacaattctatcgttgtgatcggaaatcaggctaatgtggataaggttgttagtctgttgaacggattagatcttcctccaaaacaagtgtatattgaagttctcattttagagacgagtttagaaaaatcttgggactttggggtgcaatgggcagctcttggagatgaacaaggaaaagtagcttatgcttctggtttgttgagtaacacaggagtggtggatcctttgcgtaatcagactcctcccgttgctccaaacccagggaatatctcgttgccaactccaggtcaattagctggcatcagtgatatgatgtatggatcttctgcatttggattaggaattattgggaatgttctcagtcataatgggaagtcttatctaacgttaggaggattactaagtgccctagaccaagatggtgatacaacagtggtgcttaatccaagaattatggcgcaagatacgcagcaagcgtccttctttgtaggccagacaattcctttccaaacaacgagtacggttatccaggaaactggctctgttacacaaaatattgaatacgaagatatcggagtgaatctggtcgtaacatcaactattgctcctaataatgtcgttactttgcagatcgagcaaacgatttctgaattgcattcagcgcaaggagttctcactcctgtaacggataaaacgtttgctgctacaagattacaagttcctgacggatgtttccttgttatgagtgggcatattcgagataaactcacaaaaattgtttctggggtgccattactcagttctcttcctctaatcaaaggactctttagccgaacaatcgatcagcgccaaaagcgcaatattatgattttcattaagccaaaagtcattagtagctttgaggaaggaacagtcttatccaactcggaaggatatcgttataattgggaaagtgaaagaggatctttagaagttgctcctcgtcatgctcccgaatgtcagaatgctcctaaggttcagacagaaagtgattttaaaatgctagaaatagaagcagaataa

SEQ ID NO: 8 - DNA, 534 bp, Chlamydia muridarum
atggctttcggtatgaacccctcagaagagtcttctgctctttgttataactgccagcaaccagcaacaatttgttttacagaaatttctgaaaacatcacttcgcgatgttatgtatgcaataactgcccatacccttctcgatattatgatcgagaaacggtcctcgcttctcctacaaatgaaaccctaattttagaatgtggcaattgtaaaactaaatggtgtatccgcgacacggatgagattttattaggatgcgctctatgctatagaactttcaaatctcttattttatccaggctcttacgctatcaagccatttcatcctatactgcagacaaaaccaataacttccatatcgggcgttctttaggaaatatagaaaaacctactgttaatcctgctatgcgtctgatcgctttacatgaggccttacaagagactctacgacgagaagattatgagcaagctgcagaaattcgtgatcaaattaatcagctaaaaaatcagaatacaaccgatgctccctaa

SEQ ID NO: 9 - DNA, 849 bp, Chlamydia muridarum
atgagcgacttctccatggaaacattaaagagtttgagacagcgaacaggtgtaggcctgacaaaatgtaaagaagcccttgaacatgcaaagggcaacttagaagatgctgttgtttacttacgaaaacttggacttgcctctgctggtaagaaagagcaccgagaaacgaaagaaggtgtcattgctgcgtcggttgatgagcatggggcagctatcgtcgaagtgaatgttgagacggactttgttgctaacaatagcgttttccgaacgtttgttacaggtttattatccgacatcctcaacaacaaactgagtgatgtggatgctttagctcaagtaacgtcctctcaagagccttctttatctgtagaagagctcaaagctgtaacgatgcaaacagtcggagagaatattcgtataagccgcgcgctatatacacctgttaactctaatcagagtgtaggaatctattctcatggaaatgggaaagccgttgccctggtctttctttccggatctgacaaacaagaagcgttagcaaaagatattgctatgcatattgttgcaagtcagccacagttcttaagtaaagaaagcgttcctcaagaagttttagagagagaaagagaagtattttcttcccaactatcaggaaaaccccaggaagtaattgagaaaattactacagggaaatttaaggcctttttccaagagacttgtttattagaacaagcgttcattaaggatcctgacgttactattcaggaattggttgatagagctgcaaaagctagtggagagccgctaaaagttgagcactttgtcttttggaagataggcgcataa

SEQ ID NO: 10 - DNA, 1162 bp, Chlamydia muridarum
atgaaaaaactcttgaaatcggtattagcatttgccgttttgggttctgcttcctccttgcatgctctgcctgtggggaatcctgctgaaccaagccttatgattgacgggattctttgggaaggtttcggtggagatccttgcgatccttgcacaacttggtgtgatgccatcagcctacgtctcggctactatggggacttcgtttttgatcgtgttttgaaaacagacgtgaacaaacagttcgaaatgggagcagctcctacaggagatgcagaccttactacagcacctactcctgcatcaagagagaatcccgcttatggcaagcatatgcaagatgcagaaatgttcactaatgctgcgtacatggctttaaacatttgggaccgtttcgatgtattttgtacattgggagcaactagcggatatcttaaaggtaattctgccgcctttaacttagttggtctgtttggaagagatgaaactgcagttgcagctgacgacatacctaacgtcagcttgtctcaagctgttgtcgaactctacacagacacagctttcgcttggagcgtcggtgctagagcagctttatgggagtgcggatgtgcaactttaggagcttccttccaatatgctcaatctaagccaaaagtagaggaattaaacgttctctgtaatgcggcagaattcactattaacaagcctaaaggatacgttggacaagagtttcctcttaacattaaagctggaacagttagcgctacagatactaaagatgcttccatcgattaccatgagtggcaagcaagcttggctttgtcttacagactgaatatgttcactccttacattggagttaagtggtctagagcaagctttgatgccgacactatccgcattgcgcagcctagcttgagacctctatcttaaaatgaccacttggaacccaacgatctctggatctggtatagacgttgatacaaaaatcacggatacattacaaattgtttccttgcagctcaacaagatgaaatccagaaaatcttgcggtcttgcaattggaacaacaattgtagatgctgataaatatgcagttactgttgagacacgcttgatcgatgaaagagcagctcacgtaaatgctcagttccgtttctaa

SEQ ID NO: 11 - DNA, 1005 bp, Chlamydia muridarum
atgggtattcgacctactggtgggaataacggatatcagtcccttccaatttctggagacagtgacagtgatagcgtgagtaatgtcagcagtgctggatctcttggaagtcatagtatttcttcccaaggaagatctaaaggcatatgtgcgcgaatagctgatgtatttagaaattgtttctctcgtaatagtaaaactgcctccccatcatctagtaggtctattacccaagcggatattcatcacccaactctttctggacagggaacccaagcaattctctctaccggagatgcaaaagtggacagtgcagttattcatggagatttgcgtgcacagaatacacggacagtagctacccatattcagagtaaattaaaatccatggagaaacagtcatctggcaactataaagcaggggcgtatgatgcagtaagatatgccttgtttaccccaggtgggacctctgtgaatagccagcaagctcaccagatttgtactcgtggtagagacttgtggcaacagtcagtagacgatcttggggagcatgaaaatactgatggacttatgatgctttcttgcctctgtttaggagggagacaggtgcctacaggtcagttaagagagtttatggaaggggttagagatacctttaccgatgaaggagagtctgttgatccgacgacagatgatattcttgacttagcagcccaaatcgatgctgcagaactttctaaaccaggtagtaagaacgatatcttagcttacttagggaattgtgggaaagccactttagataatagccaagtgagtaatcttgttttagatagtcaagaagagaccagtcctcaacaagttcgagacaattcccaagagatccaacgattattggattatgcgcaacaaacagatcccgttttgtttttacaaacagtaacagcgctaacctccgatatattcttcgaaggcggagagagtgtaggagatcctttcgattactaa

SEQ ID NO: 12 - DNA, 2907 bp, Chlamydia muridarum
atgatggatttccttaagcgttttttcggatcttcccaagagagaatattaaaacgattccagaagttggttgaagaggttaatgcttgcgatgagaaattttcgtctttatctgacgatgagctccgcgaaaaaactcctcaattgaagagaaggtatcaagaaggggagtctttggataaactccttcccgaagcatatggtattgtaaagaatgtgtgtcgtcgcttggcaggaaccccagtggaggtttctggataccaccagcagtgggatatggttccctatgacgtgcaaattcttggtggtattgccatgcataaaggctttattaccgagatgcaaacaggagaaggaaaaaccttaactgcggttatgccgctttatttaaacgcgttaacagggaaaccggttcatctcgtcacggtaaatgattatttagctcagcgggattgtgaatgggtaggttcggttttgcgttggctgggcttaacaacaggcgttttagtctcggggattcctccagaaagacgtaaagcgatctatcagtgtgacgtagtttatggaactgcttcggaatttggatttgattatctccgggataattcgatcgcgacaagaaaagaagagcaggttggtcgtgggttctatttcgctatcattgacgaagtagattctgtactaattgacgaggcaagaacaccgctgattatttctggtccgggagaaaaacataatcctgtttattttgaattaaaagacaaggttgctgagttagtacatttccaaagagagatgtgtaaccatattgctgctgaagcaagaaaaaccttagatccatttttagggatggatgtgcttcctaaagatagaaaaattatggaaggcatctcggaggcttgtcgggctttatggttggtaagtaaggggatgcctcttaacagagttttacggcgtgtgcgggagcaccctgaccttcgtgctatggttgataaatgggatgttttttatcatgcagaacaaaacaaagaggaatgtttagagagactttcctccctatatatcgttgttgatgaacataataatgatttcgagttaacagacaaaggaatgcagcagtggatcgagaagatcggtggagctgcagaagactttgttatgatggatatggggcatgaatatgccttgatcgaagaggatactactctttcccctgaagataagttgaatcgcaaaatcgctgtttctgaaaaagatacgcaaagaaaagcaagagctcatggattgcgtcagctgttgcgcgcccatttattaatggaaagggatattgattatatcgttcgtgatgatcagattgtgatcattgatgagcatacaggccgtcctcaagcaggccgtcgtttttcagaaggtttacatcaggctattgaagcaaaagaacatgtaacgattcgtaaggaatcgcaaacttttgctacagtgacattgcaaaacttcttcagattgtatgagaaactcgcaggaatgactgggactgctattacagagtctcgggaatttaaagaaatctataatctgtatgttttacaagtcccgacatttaagccttgcttgcgtatcgaccataacgatgccttttatatgacggaacgagagaaataccaggctattgttgctgaaatcatttccgcacatcgttcaggaaaaccgattctgatcgggacggagtcagtagaagtttcagagaagctttcgcgtattttgcgacaaaatcgtattcatcacactgtactcaatgccaaaaatcatgctcaagaagctgaaattattgctggagctggaaaggtaggagctgtaacggttgctacaaacatggctggtcgaggaacagatattaagctggataaagaagctgttgctgctggggggctttacgtcataggcacatcgcggcatcagtctcggcgtattgatagacagctacgtggtcgttgtgcacggcttggagatccaggtgcggctaagttcttcctttcttttgaagatcgacttatgcggctttttgcatctcctaagctcaatacattgattcgacattttcgccctcctgagggagaggccatgtcggatcctatgtttgaccgattgattgaaactgcacaaaaaagggtagaaggccgcaactatacgatacgtaaacatactttagagtatgacgatgtgatgaataaacagcggcaaacgatttatgcgtttcggaatgatgttctgcatgcagatgatttgttcattgttgcacgagaacaaatcgagcatgtatcgctggctttggcgtttctaattttaaaagatgctcgtgcggaccactgctctttacccaaggttgaagagtggctgagttattcattccctgtaaagctcgatgatcaggaaattcgtcgtctaggaaatgtggatgccgttgctgattatatagggggcttattgatagaggcttttgatgctaaattctcctctatgctcactgagtttacggaaattattggatcagcgtctggtgctcagggggtttgcaatgatattcttcgttcagtgatcatttcgcatattgatgaagagtggaaagtgcatctcatggatatggatttgctgcgttccgaagtagggttgcgttctgttggacaaaaagatcctttgatcgagtttaagaacgagtccttccttttatttgaagggttaattcgggatattcgtattgcgatagtgaaacatttattcgctctggagttatccttaacacgaagcgacagacctgataatgctattccaactgttgcgacggcttttcataatcacgataattttcgccctatggagctaacaattatcggagaagaggaaaattag

SEQ ID NO: 13 - DNA, 612 bp, Chlamydia muridarum
atgacgttggtaccatacgttgttgaagacacgggtcgcggcgaacgagctatggatatttattctcggctgctaaaggaccgtatagtcatgattgggcaagaaattaccgagcctttggcaaatacggtcatagcccagcttctatttctgatgtccgaggaccctacaaaagacatccaaattttcatcaattccccaggagggtatatcacagcagggttagcgatctacgataccattcgttttctgggttgtgatgtaaatacctactgtatcggtcaagcagcttccatgggagctcttctgctttctgcagggacgaaagggaaacgttatgccttacctcacagccgcatgatgatccaccagccttctgggggaatcattggaacctctgcagatattcagctacaagctgctgagattttaacattgaaaaaacacctttctaatattctagctgaatgtactggtcagccagtagaaaaaattattgaagactcagagcgagacttctttatgggagcggaagaggctattgcttacgggctaatcgacaaggttgtctcttcagcaaaagagacaaaagataagaacattgtgtcttag

SEQ ID NO: 14 - DNA, 2310 bp, Chlamydia muridarum
gtgtcaatacaaccaaagtccgtttcttttactaagaatttagtagcaccttgggccggagagcaggttgattctgccgcgatgtatacatcgcaggctgtttttttctttcagcaattggacgaaaaaagcaaagccctaaagcgggctttaggattgcttgaagaacttgatgtcgaaaagtttactccatcgctagaagaaactcccacgataatacagccggaaataacgggaagaatttcctatgatgatatcgagattatagagtctcttacccctgatataattttagcggatcctgatagggcttctgctcaggtttttggggaagggcttgcggatagttttgatgactggctaacattatcggaaaatggagggcttcaggatcctactccagtagaacaggaaatagtgactaggtatcaaacggagctgaatgctttacgtaataaactcaaacaatctgtattaacgcccgatgaatatgcgagactgtatgcaatccctcaaacttttgtaaaagagatagaaagcataaaggatgaaaataatgttaggctgattcccaagagtaaggtaacgaacttttggcaaaatattatgctgacctacacgtcagtgacatcgttatcggagcctgtttccgatgcaatgaatacctccatagcagactattctctttatatcgaaagagctacgcaagctgctagtttaattcgagagattactaaccttatcaaagatatcttcaatcctatttgggatttaagcacccaaataataacgaatgccttctctttaaatggagcagagtttaactcattagaaggagggatcattcaaagcttattaagctttgcggggctttttcgacagttaatgagccgtacttcaactgttgatgagattggtgatctctatcctcaaaacgtccaaaaccaagatgttattcatacagctatcgatgagtatgtaaattctcttactaatttaaaagttaacgatcatgtgcaactcaatgggcttctaagcttggtttatgcgtatggagcaagtactttagtttttactcaaaagtctatatccaatagtaatcagatctctttaacagagtatagcgctgctttagaaaaagaaattcagtattgggttcctagagaaactgcgaatttcaaaatttctgatcaagcattaacaacttttaaagacaaaccttcagggacttataacggggttgcccttttcgattttaatggttcagcggtcaacattttcaatcctacattcttcttcgacgtagttagtcttatgactacagatcctaagaaagcaatgacaagagaagactacaatagggtgattgctgcttcagaatcgagtattaggaaaatcaatgaatccattgctgcatgggaagctgctattgcagaatgtaatgcaaaaaaagtacagatggatcctgcagggcgcaactattttgatgctatggttttagcgaagcagactttcgtgaacacttctccaatacagatggtgtatgcgtcattgatgttggataagtatcttcccaatcagcagtacatactggaaacattgggaagtcagatgactttctccaataaagccgctcggtatttaaatgatattattgctcactcagtaagttttcaaacagcagacgtgtattatgctttggggatgtatcttcggcagatgaacgttcaagcatttcctgagtcaatttctcgagctaaaaatcttttaaacaaagagatagagcgatgtcgtgcggatctatttcactgtcaaagagctatagaagagatcaacaagctatctgcaagtgtaaaagcagatactgaattgacttcatcccaacgatcagagttattagaaactttagctagttatgcttttgaatttaacaacctttatcacaatctctctaatgtttatgccatggcttccgtcatacagatttcgggtgtagataaacctgatgaagtggataaagccttcactacgactattggaacaaaagatttagatacctggattcaacaattcactatttttgaaagtgcagttattgaaggagggcgtggtggagtgatgcctggaggagagcgacaggtattgcaaagtctagagagtaagcagcaagattacacttcttttaaccagaatcaacaattggctttacaaatggagtctgctgctattcagcaggagtggacgatggtagcagcagctttagcgttgatgaatcaaatcttcgcgaagttaatccgtagatttaaataa

SEQ ID NO: 15 - DNA, 1173 bp, Chlamydia muridarum
atgaaaaaccaaccgattcaagcaagacagaaatattttgttccaatgacagaaactgccgctcctagagaacgcagagtatctcctgcagaagtggctgcggactacacacagttgcatgaagcggcaacatatcttcaggtatttcaagatttattgaacgatacgcacgagttgggattccaagaagagtttatagaaaatttgcgtcaagatttgttaaaaatagattcagagatgtctttgatgcaagttttgtgtgctgaagatagtcaaagagaagcacgtagaaaagagcggcaagaacttcagcggcagctagaagctcgagtattaggccctcaggcattgacaactgctgaagagttgcaccccgtagacggaagcatcattaacaaaatgccatttcaggctgcctttgcttacatcctgctagataagtatattcctgctcaggaagaagctttgtacgcattagctagagagctcaacttctctggatatgcgcagacactatttagtcctattttagaattagtcaaaagctttaataacgctccgatcgtgtataacttaggatcgtatattgggcaaacaaatggaacggctaactttagatatggctatcagatggttatggatcgttacgaaatggagaatagccagttaagaaaagatatgaaaaatgcagagaatgcaaagctgcaatttgcgcaggttatcaaaaatgtagacgctaatagttctttaacaacaacccaaaagactaagctaaaagagatgtcaaacgggtatattcagaccttggatgcctgtcttacacagatgcaagcgttatctgcgggcttgcgagggttggctttcatccctggaagggatgaatttagcccagcttatgagattatgggttcttcattttctgtagttactttacaaaatttagaaggaaatgtggttgatggagagcttgatattatttcaggagaagtaaaaggtgggctgttaaactttttcacctattttcttgctgatgtgcaaaattttggagacttagctcaaacgaatcagttaatgctggagttacaaatgcgcgctatgcatcagcagtggagtatagtctcagcttctttgaagttaatgcataatgtttatagaacgttaggatccgcttaa

SEQ ID NO: 16 - DNA, 1980 bp, Chlamydia muridarum
atgctcccacaacttttctcttctccattttcacgggaattactcaacgatttttttgaatcagggatggcagaggaaaacagtcctttactttcccgaaagaatcgtcttttaagccaaaacttaaccctaaaatctgcctacatatcccttgctctttatatagggtcgcttctttctcattggaccggatatcagcctctctcttctttgctacttattcttactttcttcctagctggaacgcctgccctcgtaaaatcttttgaggatattcttaataaaacggtgaatatcgatattctcatgacatctgcagctttcggctctattttcattggaggagccttagaaggcgcattgcttttagtacttttcgctatttcagaatctctaggatcgatggtctcagggaaagccaaaagtactctcgcttctttaaaacatttggcacctactgtagcttgggttgttcaacaagatggctcattacaaaagattttagtacaaaatgtaaaagtcggagaggttatccgagttaagagtggagaggttgtccctttagatggagaaattatccaaggagcctcctctattaatctgatgcatctaacaggagaaaagattcccaaatcttgtaatattggggatacggttcccgcaggagctcataacttagaaggaagttttgacctcaaagttcttagaattggagcagagtccaccattgcccacatcatcaatcttgttatccaagcacaaagcgctaaacctaaactccagcaacgtttagatcgttactcatcaacgtatgccttaacaatcttcgcgatctcagcctctatagcaataggcggttcattatttacgacactgcctttcctagggccagacagtgctttttaccgagccttagccttcttaattgcagcttctccttgtgcccttatcatagctatccctattgcctatctcagcaccattaatgcctgtgccaaacatggagttttactaaagggaggcgtagtcttagatcgcttagtctcttgcaactccgtagtgatggataagactgggacactgactaccggagacttaacctgctgtggatgtgaagattttggccctgaatcccctcttttttactcctatgtgctagcaatggaacaatcttcgtcccaccccattgctcaggcaattgttaattatctaacagagaaacaagtgcttcccctaccggcaacacaatgtactaccattccaggcgagggtgtacaaggagaatttaatggagatcaggcctttgttggacgagtctcaacagccctacgctatgtccctgaagaatatcgagaacaacttcgcgaacgtgctcaacaagcacaagcgcgaggagagacctgttccattgcttgctctgggcaacgcgtgtctcttttttactttcgagatgccccgcgccatgatgctgcagatattgtcgcctatttgaaaaaaaatggttatccagtatgcatgctcacaggagatcatcgtattagcgcagaaaacacagctcaactgcttggaattgatgaagtgttctacgatctaaccccagataataaactttctaaaatccaagaactcgcaaagactcgacaaatcatgatggtgggagatggaattaatgatgccccggctctagcgcaagctactgtagggatcgctatgggggaagctggcagcgcaacagccatagaagctgctgatgtagttctcttaaaccaagggctctcttctcttccctggctgataaaaaaagcaaaaaagactcgccgaattgtgtcgcaaaatcttgctttggctttatctattattttatttatttcaggaccagcatctatgggaatcattcctttatggcttgccgtaattttacatgaaggaagtaccgtgattgtgggccttaatgctcttcgccttttaaaaaacacgtga

SEQ ID NO: 17 - DNA, 453 bp, Chlamydia muridarum
atgcaacttacttcgcaggctttttcttatggccgtccgattcctaaaaaatattcatgtcagggggttggaatctctcctccgctttctttttctgatatcccttcagaagctaaaagccttgctcttattgttgaagacccagatgtccctgccaatgttcgggaagatgggttgtggatccattggatagtatataacctctctcccatagtatctaatcttgcagagggagctcaaatttttgctgttcaagggataaatacagcaggagaaataggctattgccctccttgtccgccagacgcaaagcatcgctattacttctatgcctatgcattggacgttgttctccctgaagaagagggagtaacaaaagaacagttgttagaggctatggaaggacatatccttgccacagcggaactgatgggcacttatgaacaagattag

SEQ ID NO: 18 - DNA, 1296 bp, Chlamydia muridarum
atgtcttggctttcaagcctgtaccctatttttattgcttctaccgcattttgtgctttaggccttcttcttgtagccatcatccttctttccaggaaatttcttatcaaagtgcatccctgtaaactgagaatcaataatgatgactctcttactaaaactgtagatagcggaaaaacgctcctttcctctttgcttgattctgggattgctatcccttctccttgcggaggaaaagccgcatgcaagcaatgtaaaattcgcattacaaaaaatgtcgatgagccattagaaacggatcgctctaccttctcaaagcaacagttggaacaaggctggcgactttcctgccaaacgaaagtacaacatgatatgaacttagaaattgaagaacgttatttcaatgcttcatcctgggaaggcacagttgtatcaaacgagaatgttgcgaccttcattaaagaacttgttctgtctgtagatcccgcacgtcctattcctttcaaacctgggggatatctgcaaattaccgttccctcctataaaactaatacctctgactggaaacagactatggatccccaatattatagtgattgggaaaccttccacctctttgataaagtgattgatcaccaatctttggatgccaactctgcaaataaagcatattctctagcttcttatccagcagagctccctcttatcaaatttaatatccgtatcgcaacgcctccatttataaataaatcccctgatccaacgattccatggggagtctgttcctcctatatattctccctcaagccaggtgataaggtaactgtatctggtccttatggcgaatcattcatgaaagaagataaccgtcctgttatcttcctaattggaggagctggctcctcttttggaagaagccatattcttgatttattattaagcaaacatacaaaccgagagcttacgttatggtatggtgcccgctctcttaaggaaaatatttatcaagaagagtatgagaaattagaaaaggaatttcctaactttcactaccatcttgttctatctcaacctttgcaggaagacttagataaaggatgggacagtaaagacccaatcaaaacgaactttttgtttaaagcttttgagctcggacaactgagcaagcttcccaatccagaagactatctatactatgtttgtggtccagcacttcacaacagcagtattcttactttacttgataactacggagttgagcggtcttctattatcctggatgattttggaagctaa

SEQ ID NO: 19 - DNA, 345 bp, Chlamydia muridarum
atgttctctcgtgtgttgtttagtatccttttctttctaggatgttgcccatctttatttgcagatgttgattctcctcaacgagcaacatttggacagcctgcagtgatgttaggaattgctatcgtctttttctattttatcttatggcgaccagaacaaaaacgccgccaagctatggaaaaaagaaaaagcgagttagcagttggagataaagtgactgctatgggcatcgttggaacgattgccgaaatccgtgaacacactgttgttctgaatatcgcttctggaaaaattgaaatccttaaagcagctatttcagaaatttttaaggctgaaaaataa

SEQ ID NO: 20 - DNA, 378 bp, Chlamydia muridarum
atggcgctaaaagatacggcaaaaaaaatgacagatttgttggaaagtatccaacaaaacttgctaaaagcggaaaaagggaataaagccgcagcacagcgagttcgtactgaatccatcaaattagaaaaaattgcgaaagtttatcgcaaagagtccattaaagcagaaaaaatgggcttgatgaaaagaagtaaagtagctgctaaaaaagctaaagctgctgctaaaaaacctgccaaagccactaaagttgtaacgaaaaaagcttgtacaaaaaaaacttgcgctactaaggcaaaagctaaaccagtaaaaaaagccgctactaaaacgaaagctaaagtgacgaaaaaagttcgttcaacaaaaaaataa

SEQ ID NO: 21 - DNA, 573 bp, Chlamydia muridarum
atggttcgtgtaagcactagtgaatttcgtgtaggattgcgagttgagatcgatggccagccctatgtaattttgcagaatgattttgttaagccagggaaaggccaggctttcaataggatcaaagttaaaaactttttaactgggcgagtaatagaaaaaacattcaagtccggggaatctatagaaacagccgatgttcgtgaacagcagatgcgtctcttgtatacggatcaagagggggctacgtttatggatgacgagacctttgagcaagagctgattttttgggataaactggaaaacattcggcagtggttgttagaggatacagtttacaccttggttcgttacaatggggacgtgatttctgttgagccgcccattttcatggaactatctatcgcagaaactgctccaggggttcgtggagacaccgcatcgggccgagtactgaagcctgctacaacaaacactggggcaaagattatggtccctatttttattgaagagggtgaagttgtgaaggtggatacgcggacagggagttatgagtctcgcgtatcaaaataa

SEQ ID NO: 22 - DNA, 1542 bp, Chlamydia muridarum
atgcctagcgaaaacaatgagatgcatcgcagtaccatccatcaactgttctccggcctggataaagcttaccaaatagtcaaagggttttacggtcctgcttactcctttactacgaaagatttttccctgaaaggaaagggctaccacattctctctcgtatagaattgttagaccccttggagcgtctcggcgtatattttgcgcaatccttagcagaacaaatctacaatcgccatacagatggagtcatctcttccgttatcctcttgcgagcgtttttaaaagcctcgctcccctttattgatcaagggatatcccccagacttcttacatcggccttagcctcaaaaaaagaagctatttgcgctcatttacaagcccactcattcctcttaaaagatacttcaaaagtacttggactaataagctcacacactaatgatccttttattggagaagtatttgcacaagccgttgcatatacaggacaagaaggcaccattgctctatcccaaaaaagcggatctactctacgtttcgttcaaggaatacaaatacaacgtgggtatcaagtcccttcttttttcccacaagatgcttttcatgaaaacctcgtgatagcccccaaaatttttgtcacagaccaaacaatccattcggttttctcttttcttcctctacttaaacagttttctgaagaacaaactccccttatcattttttgcaaagagattgatcatcatcctctcgccacttgtattgcaaaccgtatagcagggcttgtggatgttctagtggtaaccatagaagatcccacccttctagaagacattgcattacttacaggaactacagtgttttcaacgcctcctttctccaataaacctcccatagaacttcccttactaggttcttgtacatgggctgaattgtctcaagatcacaccctattagtttgtgaaaattttgttccagaagttgtgaaattaaaaattcgccaactcgatcatatgatacaaaacgcggaaaaagaactttctcgacaaacactcaaagagcgcaaacatcgcttagaacacccaatcgcaattattcctattgaacaagacaagtcctccctatacaaactcgctttaaatactctaaatactacaaaaaaatctggttttgttgtgggaggtggggcagctcttctttacgcttcacaaaatcttctatcatctcaagatcagtctcaagaagaactcgctgcttcacatatcttacagaccgcctgtcgagctctcctagagcaactagttggctccgtacatatggatgggaaacttgttgctaacaaactctgttcattaggaactcctagtcttggattcaatgtcctctcgcaacaaatagaagatatgatctctgcaggagttattgcacctttagatactgttatggatattttctcatcttccctccatgcagccttagatctcctcctttcctcctatacaaccccgcctagtcctataacgaacgataaaaaaacttaa

SEQ ID NO: 23 - DNA, 1359 bp, Chlamydia muridarum
ttggttatgcgccctattttattaaaagagtggtcttctttgttattagatattgacattccttgctcagggaagaaagtaacgggagtcgctattgacagccggcttgtattgccaggggatgtattttttgctcttccagggaatcgaactactgggcacctatttttaaagcaggctgcgcaatccggagctgttgctgctgtagtagcgagtgattatcgtggaccagattatgggttacagttgttacatgtggcagatcctagagaagctttaagagcggctggacgaactcagggagctcttttccatggagaagtgatagggataactggctctgtagggaaaacgacaacaaaaagttttacccaacaattactttctcctttttacaaagtctttgcaagtccgaaaagttataattctcagctcactctacccctaagtatattaacggccgatggagatgaggattttcttgttttagagatgggagtttctgaacccaataatatgaaggatcttttagatgtaattgagccttctattggagtgattactcacatcgacgttcagcatgcaatgaattttgtggataaaggggctcaaggtattgctgaagagaagagtttgttgttagagagatgcgggattcatctattgcccagagattcttcatggtttaactttttcatgaaaaagaatgctgcagctgatcagttttctttttctatgaataatgaaacagcagatttttactatcgagccattcattccgaaggggtcctcattagtgctcccgatggggatattgagctgcctgtagtgttcccttatactcccgcttatatgaattttattattgctgtagctttagcttggcttactaacgttccaatggatcgtttagaacaggcaagtcaatctttatttttgccatctatgcgctttgaacaacaggaacacaatggtattcgaattattaatgatgcatacaatgcaagcccagatgcaatgctagctgctttagatgctgtccctatcccctctgagggaggtaagacagtatttatcttgggccatatggcggagttaggaagatattcggacgaatgtcatattgctgtagcaagaaaagctgtgacaaaagcacacgtagtttttttcgttggagaaaagtggtcccctgttagagaggttgtttctgatgcaaattgtcagatagagttttacggttctgttagcgagattatgcatgttgttaaatctttagtgcgacggggagatgttgttctgctcaaaggatcgcgtagtttggaattggagactttgttgccatgtttttccatctcgtga

SEQ ID NO: 24 - DNA, 732 bp, Chlamydia muridarum
atgaatcgtagaaacacgatgattgtagcagcttctgtgaatgcagtactcttggcagtgctgtttatgacagcacgctattcagagcaagaggtagagtattcgcagaaaatagcacctattaaaattttagagccggtaccagttgttgagaaggctcctgaaaaattagaaaaaaatccagaagtgatcgctaagcccgcacaggttgtgagaaatcctgtagtctctaaagcggagcttgctgcgcaattcacagataaaaatcaaactgttgagaaagagatcaaagtctctcctaaagcgacgcctcctcctgtggttgttgaatctcctacatccgaaattcctgttgtgcaggaaaaaagtgcagacaaacctgcagagcaagaagaattttctacagttattgttaagaagggagattttttagagcgaattgctagatcccatcacactacagtttctgcattgatgcaacttaatgatttgtcgtcgacgcaattacaaataggacaagttttacgcgttcctaaaacgaataagacagagaaagatcttcaagttaagacccccaatccagaagattattatgtgattaaagaaggggatagtccttgggctatagctttgagtaatgggattcgattagatgaattgttgaaattgaatggattagatgagcagaaagctcgtaagttgcgtcctggagatagattacgaattcgatag

SEQ ID NO: 25 - DNA, 414 bp, Chlamydia muridarum
atggaaaattttgcagcgtacatcgtgaaaaatttagtcactgatcccaattccgtcaaaattcgatcatccgaagataaagccagcgcaactcttaagctggaaattcacgcggactccgaagacattggaaaaatcattgggagaaaaggacaaactatacaagcattaagaactattctgaaacgcgttggcgccagactacagaaaaaaatccttgttgagcttgctcaaccagaaaatatctctcctgtggatgaagaatctttatctctaggccatgcagcaacagactcttctgacgattttgaagaggattcctttattgaagatagctttgaagaagaatcctcagttgctgtcagtactttagcgggcacatgccatggctgtaattgctctcatcatagttag

SEQ ID NO: 26 - DNA, 630 bp, Chlamyida muridarum
atgtctaaaacaccattatctatagtccatccttggcatggaccagtattaacacgcgatgattacgaatctctttgctgctatatagagatcactccctctgattcggttaaatttgaattggataaagagacggggttactaaaagtcgatcggccacagaagttttccaatttttgcccttgcctatatggccttttacctaaaacttattgtggggatctttctggggaatatagtggccagcaaagcaatagagacaacatcaaaggagatggagaccctcttgatatttgtgtactaacagaaaagaatatcacccaaggaaatatcctgttgcaagctcgacctattggaggtattcgtattttagattctggagaagctgatgataaaattattgctgttctagaagatgatctcgtttacggagctatggaagatatttctgactgccccggatctgttttggacatgattcagcactattttttaacgtataaggccactcctgaaagtttaatccaagccaaacctgctaaaattgaaattatcggcttatatgggaaaaaagaagcccaaaaagtcatccgactagcgcacgaagattattgtaatctttttatgtaa

SEQ ID NO: 27 - DNA, 1053 bp, Chlamydia muridarum
atgtcttctttacggattactagaagttgctcttttaaagggagaaagcttttagctaccatgctcttcttcggactaggctcatctagcttgtgcgctactcctttggacgagcgtaatgagctttcttggtatgttgattatcaagaggctaaaagcaagagcgaagagaaagatttgccgatgttgttgtttttctctggttccgattggaacggaagctgcatgaaaattcgagatgaagtgctgagttctgcggattttatagcgacagtttctgataaatttatttgtgtatctgtcgactttcctcgccatgcagagttacaagattcgcggatcaatgaacaaaatgaggatttaaaaaataagttacacgtaagtgttttccctagtttagtactattgtcccctgaagaacgagaaatttataagattgagagctttgggaacgaaaatgggtctaatttaggagagagcctttgtagggtaattgctaacgaccgagaattagagcacattttcccgcttattccttccttgtctgcagcagaattacgtaagtactatcagcttgcagaggagctatctcgcaaggatttcatggctacagcccttgatcaaggagtgttgtgcagtgatagctttttcctatctgaaaagtttcgacaactagttgaagccggtagaatggattcggaagaatgccgttctataaaagatcgtttgttggaattagacccagagaatgaacagcttactcacctcactgttgccttaattgaatttcaagagctagtaaagcgctcccagggtgcaacaaatgcaaatattgctgaagtgttagagcctttggtagggtatcttacacaatttggagagcaagataaggaaaatcaatggagacttgagatgattatttctcaatattaccttgatgcagagcttcctaatagtgctttagaacatgccgagattgctttcgaggcagcgccacaagatgtacaatcgagcatttctcgctcattagatcatatgcgacatcagtcttaa

SEQ ID NO: 28 - DNA, 495 bp, Chlamydia muridarum
atgagattcttgttagccttattctcgttgatactggttcttcctacaactgaagcattctcacaagaagagcgtcagtgtccacaagaggtagaggaagactcgcgtgggaaggggaaagatacttgtgtattttatagttatgagcaagctttacggcatgcaagagaacacgataagctgaccttagttgtgttattagatcgttccgaagggttttctttcgagcttctttatgaagtggcttcctctatggaggactctttgttagcagagtttgccgattttgttgttcttgctagaactggggtcgtcccgcttatctatcctcctattcaggatcctatgattggggagattacagcctttttggcggcattccctgatcaagagtttccagaacagcctgcgattattacaatagctgttggggatacctctgcagaaattatggatatcacgttgattcctcaagtgtctgaagatatcaagtaa

SEQ ID NO: 29 - DNA, 1425 bp, Chlamydia muridarum
atgaaaattactcacacagctatcgaatttgctccggtaatcaaagccggtggcttaggagacgcactatacggactagcaaaagctttagccgtcaatcatacaacagaagtcgttatccctttatatcccaaattattcacttcgctccacgagcaggatcttttcgcaactcaaaaaatcccttatttttttgccggagaacaagaagcaacagccttctcttatttttatgaaggaatcaaagtaactctactcaaattagactcgcagccagaactatttgaagaagcagaaacgatctatacaaacgatgatgcttttcgtttttgtgctttttctgctgctgctgctgcttacattcaaaaagaaggagcagacattgttcacctgcatgattggcatgttggattagtcgcagggttactcaaacaacagccttgcccccagctacaaaaaatcgtgcttaccttacataattttggctatcggggatatacaacacgagaagtattagaagcgtcttctttgaacgaattttacttgagccactatcaactatttcgcgatccacaaacctgcgtcttattaaaaggagctttatactgttcggactttgtgactacagtttctcctacatatgccaaagaaatccttcaagactattcggactatgaaattcatgacgccattaccgctagacaacatcatcttaaagggatcctgaatggaatagactatacgattttggaccctgaaacagacccccatttagctaagaactatagtaaagtccttttcgaggatcctaaagctttcttcgaagcaaaagcggaaaataaaaaagctctgtacgaaacgttaggactgtctttagacaaatccccctgcatgtgcatcatttctagaattgctgagcaaaaaggcccagaatttatgaagcaagcaattcttcatgcactagaaaacgcctataccctgatcattataggcacctgctatggaggccagatacataaagaattttctaatcttcaagaatctttagcagactcccctaacgtgcggattcttttaacctatagcgatgtactagcacggcaaatttttgctgcagcagatatgatctgcattccctctatgtttgaaccatgcggactcacccaaatgattggcatgcgctatgggaccgtccccgtagtaagagctacaggaggtctggctgacaccgtaacagatggagtaaatggattctctttctctaaccctcatgatttccacgagtttcgaaatatgctttcaaaagcgattgccacctaccgagacgaccaagataagtggcaacagattgttcgctcttgcttagagttttcttcggacttagaaactgcagccaataaatatttagaaatttatcaacaataa

SEQ ID NO: 30 - DNA, 1353 bp, Chlamydia muridarum
atgattttgccttactattcctcaggattacgcattggatctgccgttctatttttttctgcagtgatccatacttttcttactccatggttaacgcgactatatgaggaatgtctgcataaaaagatgatttttccagaacgctggcgtcaatacctttggttaagtgaacttcttcgtattgttagccgcgttgaattagtgtttgtgctttgggcgatccctctgttttttttatttttgtatacagaggggtatcgcgtaacaatggcctacttcgatagccgtaactacgtattctctctttttattgttgttatgctgattcttctcgaatcacgtcctatcgaatatttatcccaaagaatcttttcatcagtcgctaaaattggaaagcagtctccgatttgttggtggtggaccattatgattgcagcaccactatctactttcttccttaaagaatccggggcaatgattattgctgcgacactactgtcaaaacacttttatcaactcgcaccatctcccaagttttgctatgcaactatgggattactcttttctaatatttcgattagtggattgacttcatctttctcatctcgagcactactcactattcttccagaaattaaatggacgagtagtttcattatcacccatttctgttggaaagtcattttagctgtccttatctccacaacgatttttttcttattcttccgcaaggaattcaaaaaatttcctaagacaattccaagttcaaccataatgcagaatcgagtcccttattggactattttcattcatgttgtcttggttggatgtgtcattctcagccgagcaattcctttgtttttgggctttattcttgttttctacttagggtttcaacgcttcactattttttatcaaaacccaatcaaaacagcgaaagtctgctttgtaggattattttatgcaggggtagtgattttcggagaacttcaagaatggtggatgcttgatttaatgcacggtatgtcagactttggctatatgatgacctcatatatgttttctatattcttagataatgccttagtaaaccatattgtgcataacctccccatggctaatgattgctatctatatctggtacttgttggaagtatgtctgcaggaggattaacacttgtgtccaacatgcctaatattgttggataccttattcttagaccgactttcccccaatcagatatctctttaattagactattttggtcagcattgatcccctctattgtatccttaagtattttttggcttcttagaggaatcccctcatttatgttttgtttatttcgctga

SEQ ID NO: 31 - DNA, 2820 bp, Chlamydia muridarum
atgaagcgttctcttctcctattatttttctgcagttcttcttttctcacctcttgttcaaaatcttttcaaacgattcaagatgaaaatcctttaacaattttaacccctgcattagcagaccaaaaaatagcgaaaattatctgccctaatgggcttcccctcatgattgtttcctcccccaaagcttctgaatcgggggcagctttagttgttaaaactgggaataacgctgatcccttagagttccccggattagctcattttacagaacactgtgtgttccttggcaatgaaaagtaccctcaaccctcaggattcccagcattcctgagtactcatggagggatttacaatgcgtttacttacccggataaaacatgctttttgttctctgtaaataatagtgacttagacactgctctggatcagtttgttcatctctttattcatcctttgttccgccaagaagatttaaacaaagaagtccatgctgttgagcaagaattcgcaatgcatccaaccaaagattctcgtcgcatgcatcgcattcagcaaataatagctcctaaagagcacccattaaagcgtttcggttgtgggaatctctcgaccttggatactgtaacctctcaagacatgcaaacatggttttctacccattactctccggaaaacatggctgcaatcgtctacactacagctccattagatgtagctgttccttatatagcaaaaatcttctctcaaattcctaaatcctcgaaatataccccacaaactcctttcacaaaaacgcaggatacttcctcccttaacaaactgttcattaacaaagctgtggaaccttctccacaactagctatctactggcatttatacgacgcaccagcttctctgcaaggatgggcgcagtcactggtttctgtgctatccagtgaaaaagaacatagccttattgctttgcttaaaaaagaacatcttatcacccacatggaggctgggacttataacacctctctcaacactcaagattttgaaatcatttataaactcacgaccaagggagaacgtgaatatcaaaaagtccttcaacttacttttgcttttcttgattatgttcgcgatgaacaacttcccgcctatattctcccagaactacatagaatcaattctttagaatacacctatagtacacaaacagaattgttcttaactttaacacaaatgatcccagattttgcttctgaacccctagcaacttacccctatcaatctactatctatccaaaatattctcatgaggacgaacaaacctttgctgcattattagcggatccacaacaagctcgctatatcttatcagcgactctaccaagctccttagaagatgcggacgagttttatgaccctatttttgataccattttctatgagaaacctttaaactttgagcctataaaggactattcctctctcgggtttacttttccacagcccaataaatttattcctcaaaaagtccaattattatctcaaaagaaacaacacgagggatttgctttttctccaaaactcacttataaccaagacgctattactctatacacctgcgaagattccttctacaccgtcccaaaaatggctatggaactccgtatccgatctcctcaaattcaacgagcagatgttcgttctttagtcttgcgtgatctatacagccttctagcaaacgaaacattagtaaaacattatgacgaggccttaagagccggaatggatttttcagtatctcccggagctacaggtgtagacctgtctctttttggctatacggagacctctccagttcttattgactctctattatcttctctacgcgatcttcccttagataagagtctttttctgtactacaaagaccagctctccgagcaataccaaaaaggtcttatttcctgccctatgcgagctggtctcaataaactctctggggaactcctagaaggcttcttttctctagaagaaaagcaaaatgctttagatatcatctcctatgaagaatttgaggattttgctcacaaaatgctcactgaactatctatagaggctttcacgctaggaacactttcttcacaagatctttctaacgtattagcatctctttctcatttttcagaggcttctttaccatatgatcctcctagttactatcctaagagaaagcctctcttcacaacagacttctctttccaatatcctctttctgggaatggtatgctcctgcttgaacaaaacgagcatcccaatcagtatgaagattctgtagctacgagcatgttattatcttggatccacaacttgtattataatgatttgcgtaccaaccaacagcttggatacatggtaggtgctaaataccaagaatttgcagaaactccttgtggactattttatattcgctcgaacaaatcttctccagaagagcttgtgaataaaacacaactcttcctacaaaagattgctactgatccggaagcctcaggattgtctgaggaaatttttgaacaacttcgagaaacctatattcaatccgttttacttccaagtgcaacgccttcagcaatggcaagaaaattattttctatagcctttgaaacagaaaaacatgatttctcccgccctgataaaaaaattgctgcagcccgttctatgaactactcctatttcaaagagtattgcaaagaattttttaatcaaaagtttgggccagaaatccagcttcttatttacggatctgactcacaacaaaacgaataa

SEQ ID NO: 32 - DNA, 1494 bp, Chlamydia muridarum
atgatgaaaagattattatgtgtgttgctatcgacatcagttttctcttcgcccatgttgggctatagtgcgccaaagaaagattccagtactggcatttgtcttgcagcatctcaaagtgatcgggaactttcccaagaagatttgctaaaagaagtgtctagaggattttccaaagtcgctgctcaggcaactccaggagttgtgtatatagaaaattttcctaaaactgggagtcaagctattgcttctcctgggaataaaaggggttttcaagagaatccctttgattatttcaatgatgagtttttcaatcgattttttggtttaccctcgcatagagagcagcctcgtccccaacagcgtgatgctgtaagaggaacaggttttattgtgtcagaagatgggtacgttgtgaccaaccatcacgtagtggaagatgcggggaaaattcatgttactttacacgatggacaaaaatacaccgcaaaaatcataggattagatcctaaaacggatctcgctgtgattaagatccaagcaaaaaatctcccttttttaacttttggaaactctgatcagcttcagataggggattggtcaatagccattggaaatcctttcggattacaagccacagtaaccgttggcgtgattagtgctaagggaagaaaccaattacatattgttgattttgaagattttattcagacggatgcagcaattaatcccgggaattcaggtggtccattattgaacattgatggacaggttattggagtgaatacagcaatcgttagcggtagcgggggatacattggaataggatttgccattcctagcttaatggctaaacgagttattgaccaactcattagcgatggacaggtgacgagaggatttttaggagtaaccttacagcctattgattcggagcttgccgcttgttacaaattagaaaaggtgtacggagccttgattacggatgttgttaagggatctcctgcagaaaaagcaggtttgcgccaggaagatgtcattgttgcttacaatgggaaagaagtggagtctttgagtgctttacgtaatgcgatttctttgatgatgccagggactcgtgttgtcttaaaagttgtgcgtgaagggaaattcattgaaatacctgtcactgttacacaaattcctgcggaggatggggtatctgctcttcaaaaaatgggagttcgggtacagaatcttactccagagatatgcaagaaactaggattagcgtctgatactcgagggatttttgtagtgtccgtagaagctggttctcctgcagcttctgcaggagtggttccaggacaacttattctggctgtaaacagacagagagtttcttctgttgaagaattgaatcaggtcttgaagaatgcaaaaggagagaatgttctccttatggtttctcaaggagaagtcattcgattcgttgttttaaagtctgatgaatag

SEQ ID NO: 33 - DNA, 2763 bp, Chlamyida muridarum
ttgattagcattgtagtgagttttatggctaaagataaaaaaacaaatccagaatctaaaaaaagttttcctactgcttttttctttcttttgttcggagtaatttttggcgtagttacagtccaaaactttttctctgctaaaaaagcttcggtgggcttcagccatcaactcgaacatctcgtgaatctcaagttactgattccagaagagagccgtaagatcgctttgaatgataatttagtgtcattcagtggacgtttccgagaatctgttccagctgaaggtcaggttcggtaccagtatcttaatcttattgatcgtaaacatcagatagattttgagttggaagaaacaacgacatccttgtcggttttatcaaaagaagttcgtaatgcggtcacttggttttcagctatttctggaatgccaatccctgaatccggttatactatttctcctcgaacggatgtaggactttcggttttagagcctttagttattcatggtcctgtaagtgttcagattgtgaatctggctactttggaagaccgggtacgttctttacctagatctgcagaaagtcttagagtttttggttccgatttgtatgcgttgattgggaaatatctttcgccagctttgggaataggctctgaatccttgaaaaaagaaattaaggatttgtatcagcaggtagaaagttctctaactcaagttgttgaaggggagcaggctatcaccttgtacaaaacagtattagagactttacataggatttctttatcgcttgtttctccagaggatggagctcgtttcaatcaattgcgttccgtacgtctgtatcgtgaagatttcaacagatgtatgaaattattaggggaaagtgatgaaattcaagctcagctcgacaaaattcggggtgaattagtccaggctgtttggtatttcaataaccaagagctttcttctcgagctttagagaaacaagatcctgaagttttcagccgatggtttgaaggtgctaaacaagagtgggccgcgttctctggaaacaaatctttgtcatttagagctccagaccagccacgaaatttagttttagaaaaaacatttagaagtgaagagccaactccccactattctagttatcttttcacttttatgccgattattttggtcctgctatttatctactttatcttttctcgtcaggtaaaggggatgaatggttccgccatgtcatttgggaaatctcccgcgagattgttaacaaagggacagaataaagtaacgtttgctgatgtagcagggatagaggaagctaaggaagagcttgttgagatcgtagatttcttgaaaaatccaactaagtttacgagcttagggggacgtattcctaaggggattcttcttataggggctccaggaacaggaaaaactttaattgctaaagctgttgctggtgaggcagaccgtcccttcttctccatagcaggctctgatttcgttgaaatgtttgtaggggtcggtgccagcagaattcgagatatgtttgagcaagctaaacgaaatgctccctgcattatttttattgatgaaattgatgctgttggtcgtcatcgtggtgctggtattggagggggccatgatgaaagagagcagactttaaaccagctattagtggaaatggatggcttcgggacaaacgaaggggttatcctcatggctgcaacaaaccgtccagatgttttagacaaggctttgttacgtccaggacgatttgatcgccgtgttgttgtgaatctccctgatataaaaggccgtttcgaaattctttcggttcatgctaaacgcatcaaattggatcctactgtggatctcatggcagttgctcgtagtactcctggagcttcaggagccgatttagaaaatcttctgaatgaagcggcattgttggctgctagaaaagaccgtactgctgttactgcggttgaggttgcagaggctagagataaggttctttatggtaaagaacggcgtagtttagaaatggatgttcaagagaaaaagacaacagcatatcacgaatcaggacatgctattgttgggctttgtgttgagcattcggatcctgtggataaggtaaccattattcctaggggattgtctttaggggctacacacttcctcccagaaaaaaataaattaagctactggaaaaaagagctttatgatcagttggctgttcttatggggggacgagctgccgagcaaattttcctaggggacgtttctagtggagcacaacaagatattgcgcaagcgacaaagatcgtacgtagtatgatttgtgaatgggggatgagcgatcagttgggaaccgtagcctatgatgagcgttcggatgcagctcctactggatatggatcttatcatgaaaaaaattattcagaagagacggctaaatccattgataatgagctcaagactctattagatgctgcatatcaaagagctttggatattattaacagtcataaggaagaattagagcttatgactcagatgttaatagaatttgaaactttggattctaaggatgttaaagaaattatggaccattcttgggatgcagagaagaagcgtgctcgtatgaaggaagaaggtatgttgtataagaaagtatcagaagatcttcctcctccccctccccaagaagatgtgcaggatggaacgttgaagtttaatatcggcacgtaa

SEQ ID NO: 34 - DNA, 2082 bp, Chlamydia muridarum
atggcttttgagactttttctgttgcgttagacaaagataagacactgattttcgagacagggaaaatagctcgccaagccaatggagctgttcttgtcaaaatgaatgaaacttgggttttttcatcagcgtgcgcggcctctttatcagaggccgtagattttctgcctttcagagtagactatcaagaaaagttttcctccgcggggaaaacctctggaggatttctgaaacgcgaaggtcgtccctccgagaaagaaattcttatttctcgactgatagatcgctctttgcgtccatcattccctaatagacttatgcaagacattcaagtcttgtcctacgtttggtcttatgacgggaaaactttaccagaccccttagctatttgtggagcttctgcagctttagctatctcagaggtccctcagaattgtattgttgcaggtgtacgcgtcggtctcgtcgaaggaaaatgggtagttaacccaactaaagatgagttagacgcatccaagcttgatctcgttatggcaggaacagcttctgcggtattaatgatcgaaggtcattgcgactttttgactgaagagcaagttttagaagctattgcttttggacaaaaatacatagctaaaatatgtgacgctattgaagcttggcagaaagcgattggtaaggaaaaacagctctcggctgtccttgatctgccggaagatgtgcaaaatgttgtttcgaattttattagagaaaaattcgaaaaagcactgtcttttagagatagagacgctttagaacaagtctcaaaagagttagaagaatctgttgtcgccaacttagttcaagaagaaagtgatttttctttattgaacgtgaaagctgcatttaagaatgcaaaatccaatcaaatgcgagctttaattagagatctcggcattcgcgtagacggacgaagtacaacagaaattcgccctatttccatagaagtctctttccttccacgaacacatggaagctgcctatttacccgtggagaaacacaaagtgtagctgtatgcacacttgggggtgaaagtatggcacaacgatttgaagacctaaatggggatggagcagcgcgcttttatttgcagtattttttccctcctttctctgtaggagaagttggtagaatcggatctccagggagacgcgaaataggtcacggaaaattagctgaaaaagctttaagtcatgtccttcctgaagcatctcgattcccttacactgttcgagtggagtctaatattacagaatccaatgggtcttcttctatggcttctgtatgtgggggctgtctttctctgatggatgcaggagtgcctatcaaagctcctgtagccggcattgctatgggtctaatcctagatcaagataaggctattgtcctttctgatatttcagggatagaagatcatctcggcgatatggattttaaagtcgcgggaactgaagaaggaatcacagcattccaaatggacattaaagtagaaggaattacccatgagatcatggagcaggcgttggcccaagctaagcaaggtcgaagccatatcctaaatcttatgacacaggtaatgtcttctcctaatgattctgtttccagatatgctcctcgtattgaaactatgcaaatcaatacttcaaaaatcgcgacagtaataggtcctggagggaaacagatccgtcaaattattgagcgatcaggagctcaagttgacattaacgataacgggctcattaacatatcagctaacacccaagaatctatcgataaagctaaggagcttattgagggattaacgggagaagttgaggttggcaagatctataacggccgagtcacttccgttgtggcctttggagcatttgtagaagtccttcctggtaaagagggtctttgtcatatttcagaattgtctaaacaaaaagtagacaatgtagctgatttcgtaaaagaaggtgatcgcctagcggttaagttgctcagcatcaatgagaaggggcaactaaaacttagccataaagcaactttagaatag

SEQ ID NO: 35 - DNA, 279 bp, Chlamydia muridarum
atgaaaaataaaatttttgagttacttaatcacctatattctaagcaggaaaaacggctaatgactctgggtactagcatggttcccgaattgacaacagaagatcttttacagccgatggattatgatgaactcgaggggaacccttcttttagatttgaagagggggttttgagtgggataggagaggttagagccgctctttattcctttttttctgaccaagaagactccatgcgtgaggagttttctagcgatatatccctctgtaaggattag

SEQ ID NO: 36 - DNA, 1806 bp, Chlamydia muridarum
atgaaaatgaataggattttgctactgctgctaaccttttcttccgctatacattctcctttgcatggggaaagtttagtctgtcagaatgctctgaaagatttgagttttttggagcatttgctgcaagtcaagtatgcccctaaaacttggaaagaacagtatttaggttgggatctttctaaaagctctgtttttgcagagcagaaattgcgttccgaggacaacccttcaacaagcttttgtcagcaagtaattgcggactttattggagcgttgagtgattttcatgccggggtctctttctttgctgtagagagtgcctaccttccctactctgtacaaaaaagtagcgatggacgcttctatttcgttgatgtaatgaccttttcttctgatattcgcgtcggggatgagttacttgaggtagacgggcagcctgttgcagaagcacttgctaccctatatggaaccaatcacaaggggactctcgctgaagaatctgctgctttaagaacgttattttctcgtatggcttctttaggacataaagtcccttccgggagaatcaccctcaaagttcgtcgttcttctggttctgtgaaagatgtgcgagcaaaatggcgttatactccagaaagtgtaggggatttagctacgatagctccttccataaaagctccacagctgcagaagtctatgagaggggcctttcctaaaaaagaaagtgtatttcatcagtcgagcactctgttttattctccaatggttcctcatttttggtcggagtttcgtaatcactacgcaacgagtggtttaaaaagtgggtacaatattggggataccgatggatttttcccagtcatgggacccgttatttgggagtcggacggaatttttcatgcttatattttccccttggttgatgaaaatggtagaagccataacgtaggatttatcagaattcctacgtatggttggcaagagatggaagatttagattctatagggacacctccttgggaagagtttggtaagatcattacgctattttctgaaaaaacagaggctttgatcattgaccaaacgaataatcctggggggagcgttatgtatttatacggattgctctctatgttgacggataaacctttagatcttcctaaacatagaatgattctaactcaggacgaagtagttgatgctttagattggttgaatttattggaaaatgtggatacaaacgcagaggctcggattgctttgggagataatatggaaggatatcccattgacttgcaggctgctgaatatctgaaaagctttgctcatcaggtattggcatgttggaagaatggagatatcgaattatctacaccgattcctctttttgggtttgagaaaattcatccacatcctcgagtccaatatactaagcctatttgtgttttgattaatgaacaggatttttcttgtgcggatttcttccctgctattctgaaagacaatgacagagcccttgtcgttggaactcgaacagcgggagctgggggatttgtcttcaatgtacaattccctaacagaacgggaattaaaagttgctctttaacaggatctttagcagttagagagcatggggatttgattgaaaatgttggggttgaacctcatattgaaattcctttcacagctaatgatattcgttatagagggtattctgaatatattcagaaagtacaaaaattggttgctcagctaatcaataatgacagtgtaattattctctcagaggatggaagtttttaa

SEQ ID NO: 37 - DNA, 1473 bp, Chlamydia muridarum
gtgatacaaacttctgcaactatggatacctcttctcctttttccagtgtgtcagcaaatccttctttcaaaggagacctagaaaatttatcccaaaacactgttcaagaaagaggagtattgaaaacaaccataggagatgtcactctgtctcaatctattgaagaggggtgtaacgaatctctgatctccttgttaggaatcgctagcatttatgcagctcaggagggactccttcccccagctttccaacacaacctcattttccttcctcctgaaacagtcgatctggaaattcaaattgcagaacttgtacaagatttggaaaaaactccctcttccgacacccctctttctttgcaaaagagcacagtttctccgaatcgtcccaatccgacaacaaaatcttccatattttctttacaaacgaaggcatcatcacagtcccttccttccctctcttctaaagagccatctactcaacctttagcccgcccccttgctatgcaaggacaaccctctctattttcacattcagagcaaaacatagttagagctgttccttcgtctatcgttcctcataaccgagctaatccaacttcctctcaaaactcttctaacgataatacacgctctcaccaatctgggctctcaacgggaataacgttcttttctcaaaaggaacaggatctatctggacaaacaaacaaaactggttcaacagaaaaagaaaaacaagagggccgtcaaagggaaaactctgaccgagagcgcaacggagatgattcttatcaggaagatgatcaatcagaaaacataaagatatcgtcggagagaaaaaataagaacaaaacgtcatcgaatcaggaaaatgagaatcttgaagaggctttctccgtttcctactttgcctataactccactccaaaccaaaaatctagtcaaagtactttccggaaaaggcctccttcccccatgtcattattttcttctcaaaattctgtggaatccctcccaaaaaaatctcctcgaatcgaaaacgttttcacccgtttcatggagcttatggccagaattttaggccaagcagaggccgaggcaaacaagctctatgcacgcgttaaggaacgtacagataatgttgattcacttactctgctattgtcaaaaattaacaatgagaaaggagccattgactgggatcaaaatgcagaaatgcgcgctcttgttgatcatgcaaaaaacttaggagtctcgattggagactcgtataactggtccgaagatgaaaaaaaacttttgaaagaaaacatccagatgttcaaagaaaatatggagaaaattactcaattagaacgaacagacatgcaacggcttctccaagaagtctctcaatgccatcaaacaagatctaatgttttgaaactcttgaaggaacttatggacacttttgtccacaacttgcgtccctaa

SEQ ID NO: 38 - DNA, 1008 bp, Chlamydia muridarum
atgaacataacgaataacccaccaccaaccacttcttccttggctccctttataacctcagactctagcaatctttccaccaccccccaatcttttaaagaggcttctttagtggacaaggttattagagtattgttggttctcttccttattatattctcttgcggactcatcctctgtgcgtactcattccgagatcttttagacatagacaccgcaacgcaagccccttctggacctgcagatagactcctagctcatgttgaggatgctttatctggtcctgttcctacttgggataatgaacacctattccaacactcttgcctaatgtacgaaaaatacggaaccgttctcccattgaatatcttcgccccacttactaaattcaattgtgtcgaacatatttgtaactgcctacttgccaaacaaatcctcgaacaatgtggagaatgtgatcttccttgtcctcctacctgtacaccagaaaattactaccaacttttaagagaagcctgtgtcttcccattcatcttatggcatgatcctcacgcacatacacaagaagctatgttagcaaaaatggaacaaaacatacgctctggacgagttggaaatagccactgggcattaatcattgtagatatatgccgaagatgtgtcacatattttgatagcctttacgactttgtatggcatcctgaacaaacccaagcacaactaaacgagctagcttctgctctcgggaatatctatccagaaggagaatctaatactcctttccaaacctgcatcggatcaacattccaagtacaacccctaggagaattaagctgtggtgtttggtgctgccaattcttagagtggtaccttgaaaatccggatttctctctcgaagataaagtccccgtaagcgtatgcgatagaaaatctatgctcactagattttgcgctgcatcccaagcatccatgtccaaatattccgctttaaactggccatcacattaa

SEQ ID NO: 39 - DNA, 1845 bp, Chlamydia muridarum
ttgttttattttttaggttggtttgttatgggcatcaagggagtaggcggtagcggtcatagcgattatccaatcccttctcataatggagatggggagagtgaaaaaaacagctcagattcaacaagtagtaaggttaatgcaaaagttacttcttccttacagggggctccgtcaacgaatgatgaaaattcagtttccccttattctgtggtggatgtcactgatttaatagagagcggagagtcttctaggcatgtaataaagaaatctatagaaacagaagaagctgctcatcgagaatctagtgtagagggggctgggcattcttctcgcggaatatttggacggttgcaagcaggattaggacgtctggctagaagagtgggggaagctgtcagaaatactgtaggctctatctttccacaaagagctggtgctgagcaaagaacaggcaaagctcggacaaaatattccccttcagcatcaagaggattacgcctcatgttcacagacttctggcgatatcgagttttgcatcggaatcctcctatggatggactttttgcaaagcttgatgccgatgaggctgaagatatggcagcttacacgaaagagtatgttagcaatctagaaaaacgaggagcagctgatcgagaaactatagaacactgtcaaatggtagctaaaaattgggaaaaaagagctagagatttgcgagacatgggggccgcaaaaaaatttttacgcgacccttttggtaagagtgatcctaagtataaggggacactgcctggagaatacactgtcggaaataccatgttttacgatggaccaggtgtgagcaaactatcagaggttgatacaggtttttggttggacatggagaagctctcggatgctgtcttgtctgcaaatattcaaaaagggcttcgagctcgatttgttttaaatcagtctattccacagttagagagtctagaagagcgttttagaaaactggagagtgcttgcgatgaggctcgtgcttcgttaaaggaagcaggttggataaaagaaggcaaggaacctaacaaagcgcaacgagcttttcggcgatttgtagaagaaagccggaatctagagctttcttttggtagttttggagaaagtgctcgtcgtctttccgctcgtgtttcccaaggtttagctgctgcaggggaggcaattcgccgctgctttgattgtcgcaaaggcaaatattcccttaaaaaggacttgtcttctgaagaattaaatttggcagaagagttaattaggtttactgatgagatggggatagagagagacccagatggaaattacaatattccttgggtagaaaactggagaacaggagttcctgttattgaaggagaaggggcagaacatatttatgaaacgatgatgcctgtccaggaatcttttgagcaggtttatgaagttatggatatgggattggaagagcgtagggattttgctgtgagtcaacaacactatcaagttcctcctagatcttcgttgaattacgagactccgcgattcagagaatatgacgttccacgtaattccgctcgttcttattacgatgttccaagagtacctccccaaaatgaggtagaagagatgcatgtgactaaaggaatgaggagttctgtgtatgcttgttttgtagcaggaatgcgcaactacattgtttcacagccacaagaacagattccaaattctgaacaggtggagcagcttttccaagagcttattaacgatggggatcagataattcaagagcttatgaagatatggaatgaggaactagataatcaataa

SEQ ID NO: 40 - DNA, 270 bp, Chlamydia muridarum
atgctttgtaaagtttgtagaggattatcctcccttattgttgttcttggagctataaatgctggaattttaggagcaactggttatagagtgaatattgttgctcgcctgcttggcgaaggcaccatgttaacacaagctgcctacgtagtggcaggaatcgctggggttatagccttcttaaacttctttaaatgctgctttaaaaaacgtcatagcgactgttgctcctctaaaggaggatgtcaccatcatacggacagagaataa

SEQ ID NO: 41 - DNA, 1257 bp, Chlamydia muridarum
atgatccctttcgtctcgtggatttcacataattggttacaaaaacttgtttctttaggttttgccattattatctgggtattagctaatcagtctatgactgtgacaaggacctttcataatattccagtacgcgtaattgatctatctccagaacaaacagtcattggcttgcaacccgatggcttgctaaagaaaaaagtagcactgatgataactgggaataagtcggttattgaaaaacttcgccccaccgacctagagattgtgattagtgctaaaggacgaaccgaaagttggatagaaactattgatccttataatttggtttgtttagatacagacattcgcctgcgccaaaatatcaaaaatttaacatctgaagatatttttattcgtctaactcaacttgttacggaagatattgctgtcactattacaaagcctatagggaaagcccctaaaggatatgaatatcttgatgtttggccaaagtacttagtacaaaaggtaagtggccctaaagaattcgtctcttctttgaaggatcaagggctaaatcttaccttcaatctcaatacagtttcttttgaagaactagacagtagtcgcctagctcaaggaaatcctgatgaaatagtataccatgttcctgaagattggaaaaaagtgtatatcccttttaataacagctatgtggaattaaatgatcctcgagcagattttttacggcttgttttcttaaaacaagagttcatccccctcaatatcaatcttcctgttcttttgtttttccctgtagaggacagtctatttataaatcctcaaaattattatcttgagcagaatcctccactggtcctgaatcatggaatttaccaattagaccttcctctctatgtaaaagatgtcagccatctatttctgaatgttgtaaagaataatattgctctcaccatcattatggaaccttccataaaatctcagaaagaacgcttcatccattgggctgtagaatttttagacgaaaaaaccttagaagatgcctttgttcaagcagtccttgctcaagaacgcgaaattactaaacatatgctcctggatgaagcaggaattcgacatcgctttagagaatacttgcgtaaacttacactatttgaccaaaatggagagcctttagctttgacagcgcgaacatcaggaaataaggttattattcaagtcgcttcttcctctttaaataaaaaatctgcctga

SEQ ID NO: 42 - DNA, 1341 bp, Chlamydia muridarum
gtgcgaacgttgtctatttctatgctcattcttgccctttcttgtggggaaaacacctgcttatgtgctgcggattcccccaaagcgaaagttgatgcttccatcggtaatggggcaagtttttctccatttacaggagaaatcaaaggaaatcgtgtgcgtctacgtctggctccacacacggatagttctatcatcaaagaattatctaaaggtgactgcctggctgttttaggagaaagcaaggactattatgtagtggctgctcctgaaggggttaggggttatgtgttccgcactttcgttttagataatgttattgaaggggagaaggttaacgttcgtttggaaccttcgacttccgcacctattttagcaagattatccaaaggaactgttgtgaaaaccttgggtgctgcgcaggggaaatgggtggaaattgctcttcctaagcagtgtgtcttctatgttgctaagaatttcgtcaaaaatgtgggtgctttagagctatacaatcagaaagaagggcagaagaaaatcgctttagacttgttaaattctgctatgagtttcgctgatgctgagttgcagaaaaaggtagaagacattgatctagatgccatttataagaaaatgaatctagctcaggcagaagagtttaaagatgttcccgggttacaacctttagtacagaaggctttggaaagagttcaggaagcttttcttgcaaagtccttggaaaagggctcacacaaaactgtagaatcctacaaacctgtggaaactcaagctcaattacagccacagcgtcaggttatagaagaaaagaatgtgtcggtggttccagaggcgccggttttgtcgcaagtagaagagccgaagagtgtcctaacttcctctagtgaagtagaacctttgcaggacgttggtcctataaaaggttcgctgttatctcattatattcgtaaaaagggatttgttaagacttctcctgtggtagaagggagagagagctttgaacgatctttgtttgaggtttgggtaaatcttcaacctgaagagattcgaaatggactgactatggagtctttctatagagatgagcagaagaaaaaacgggtgctgaccggggaacttgaggtatatcctcatatcgttaaaaataatccaggtgattatcttttgaaaaatggagaagatgtagtggcatttgtttacgccacgagtattgatttaagtaaatggctagggaaacgtgtggttttagaatgcgtttctaggccgaataatcactttgcctttcctgcctatattgttttgtcgataaaagagggcgcttga

SEQ ID NO: 43 - DNA, 1884 bp, Chlamydia muridarum
atgacgagcaattacatgagtcgcttatattccttgaataagagtcgtcgcattcttcattcctcctataaattgctgaaaaataagaaaatgctctcttatcctgatactcagaaggaattacttgaaatcttaaaacagcttgaagaagccattttggatcaaaatagagaagacgcctctcttttcgctaaacaagctcaagctattcaaaaacgattccctcggtcaaaaatacaggcaacttttgatctcatctatgctttagcatttgctgcagttcttgcttttttaattcgtcaattctggtttgaactatatgaagttcctacaggatcaatgcgacctacaatccttgaacaagatcggattctggtctctaaaactacatttggacttcgcctgccttttagtaatgaaagtattggctatacaccggagactattacccgaggagaacttgttgtctttaccgttggagaccttcccatcccgaacgctgacaccaaatatttcggaattatacctgggaaaaaacgttatataaagcggtgcatgggcaaacctggagacactttatacttttatggggggaaaatttatggaatagatcgtaatggcgtccctatcaccacaaaaaatacagaaaacctttatcacatcccctatatctcttttgatggcgttacagaaatcgttaatcattcagatgatcaaactgatgtgatctttaaccaattccatactccctgtgggaaaatttccttcccccactattctcatgggcaatttttctacaaagatgcttggcacaaagacaccccctatgctttaaaagaccttcataccgagcctttaagctatgcagacctatttggcataaaaaattttgcaatggtgcgtattcttacaaaaaaacaagctgcgcttactcacgtactttcttctcctttagcagatgcctacttagaaattgcacatactcctaatgtctcttatcctcatccgcatttgcgtccgttagaaacgcaacttatccccactattgagcctatgaaaactctccttcctctaaggaaggagcacatgcatttgatccgtaataaccttacaacatctcgtttcacagttattgatggatatgcctacaaatatcaacccactccaattaatacttctggcatagcaaaaatatttgctcttccaatgccaaacattccggatggctgttatgagttttctaaaggggatgtgtttaaaattagtataggaggtttccgcactaaactgaaacaaccccatcctttgacgcaattgagccattctcagattattgatttattcaactgcggcattagttttcatacagtctatatccccaaaaatcctcaatacgccccttttcctaatcgttatgcttttttcaatcagggaaacctatttgttatggattccccagttttcattgacagtgatccttcattacaaaaatttatcttggcggaaaaagaaaaggagcttcagtcctctgaagaaaaaccctacattgccttcattgatcgaggacctccccctgaatctgcagaagaatttacttcttttattacaaattttggacttaaaataccggaagggcatgtgctcgttttaggagataattgtcctatgagtgcagacagccgtgattttgggttcgttcccgtagaaaaccttttaggatccccggtagctattttttggcctattaaccgtataggatcattatcttctagtatcaccccgttgagcttacctggttatcttgttaatggattagccttaggagctcttatttactttgtgggtgcgtggtattatcgaaagaatcacaggttattcccctaa

SEQ ID NO: 44 - DNA, 573 bp, Chlamydia muridarum
atggggattaaagaagacaactggattcgcaaaatggcaattgaagagggtatgatagagccatttgctgataatcaagtaaaagtacatccagaaactggagaaaaactcattagttatggcttgtccagttacggatatgatttacgtatctctagagaatttaaagtctttaccaatatatacaattccctagttgatccgaaatgtttcacagaagacgctttgatttccatcgtggatgatgtttgtattattcctcctaattcttttgccttggctcgcagcgtagaatatttccgaatccctcgcaatgttcttaccgtttgcataggaaaatcgacttatgcacgctgtggacttattgtaaacgtcaccccctttgaacccgaatgggaaggatatgtgaccatcgaaatttctaataccactccactacctgcaaaaatttatgctaatgagggaattgctcaagttcttttctttgaaggagactccgcatgtgatgtttcttacgcagatcgccaagggaaatatcaaaaacaacaaggcattacagttccttttgtgtaa

SEQ ID NO: 45 - DNA, 447 bp, Chlamydia muridarum
atgaaaagtgagcgtttaaaaaaattagaatcagagcttcatgaccttacccagtggatgcaacttggcctcgtccccaaaaaagaaattgagagacaccaagaagagatccgtcttctagagagcaagatcttagaagagaaagagcgcctacaacttctgaaggaaagcggtgagatcaaagaatatgtaactccccgtagaagtcctgctaaaacaatttaccctgatggccctagcgtttcggatgtggagtttgtggaatcttcggatacagaggtcgatctcgatactagtgaaactattgagattgatttaggcgaggaaggaggagaagagagcggaagtgaactcgattattccagcgaagacgatgaagatcctttcagtgatcgcaatcgttggcgccgaggaggcatcatagatccagacgcaaatgaatggtaa

SEQ ID NO: 46 - DNA, 1125 bp, Chlamydia muridarum
atgtgtactctgatatccgcaatgcggaattttttacctcctgattgcaaacttcctactttgacttacaaacaggcccttattacttccctcgcatcggggataattttaggacttgctggttgtttggttggaatcctctcttctatcacttctctgattatcgtttctggttttattttaggagttagtcttctcattgcagggattcttctttcccagcgtttttgttctcaagacaacgtattaaaacctgaaattccagaacaggaaattccagagctggagatcccagaatttgaaattcctgaactcgagctcctagaaccaagtacccctcccccatcttttatccccccaaaaccacccttactccctaaactagctttaaaaaataccataaaagaaatgttatttggctggaacagtatagaatctgaaaaactgcttccctgttttctttcttcagacaaaattcttttatcttttaacaacccctcagctcgattcagagcatggaatatccccggatcaaatacactattcattactacctctggacaatatgcttccctaaagcttcaatccaatttgccttcggcaattgcaaattctgtacaatccatatcttgccctaaaggtggacgaggaactaatgatttattttctgcagtgattactgatagatgctgggaagaatctaaaccaagttcgggcctcttacttccaggagaatgctcttccgcaccttgggaagacaatgacgttcaatcccccacttggaattttgaaactcaaacttataataaacccactcgctttatccaaatttcggctcctaaagcctctatgtattccaatagccctgcttattgttatcaactttgctttaaagcctatttgtcctgctttaaagaggctatccgccatggctgtcacatcattcaaattcctctcatagcctctttcccagacttccttccaggctcccaacacaaagaaaaagtctggatcgattcaactaaactagccttgctccatgctatcgcaataattgctcaccaacatcgatcagataatatagtgattgttttaacgagcatcccaagacctatttatttctaa

SEQ ID NO: 47 - DNA, 1590 bp, Chlamydia muridarum
atgactcaaaccgcggaaaaaccttttggaaaattgcgctctttcctttggccgatacacatgcatgagctaaagaaagttctgccaatgttcctaatgttcttctgtatttcattcaattacacgattttgagagatacaaaagacactcttatcgtcacagcaccaggctctggagcagaagccattccctttattaagttgtggctggttgttccttctgctgttgtgttcatgcttatctacgcaaagttaagcaatattttgagcaaacaggctcttttctatgcagtgctctctccattcgttgtgttttttgcactgttccctttggtgatttacccatatcgtcatatacttcacccaacagacttcgctgatacactacaggccattctcccttctgggttcttaggcttcattgcgatgctacgcaactggacttttgcagcgttttatgttctttccgaactttggggaagtgtaatgctttcgctaatgttctggggatttgcaaatgaaatcactaaaattagcgaagctaaacgtttctacgctcttttcggagttggagctaacgtagctctcttaatttccggtccagctattgtttggtcttctaaattacgcgcaagcttaggtgaaggcgtagacccatggggagttactctttacttcttaatggctatgttcctgtgttcttgtgccattatcgctgcctgctactggtggatgaatcgttacgttcttactgatcctagattctataacccagcagagctaaaagctaaaaaatctaaacctaagatgagcatgggcgagagcttctcttatctgttaagatccccttacatgcttcttctagccttgctagttatttgctacggagtttgcatcaaccttgttgaagtaacttggaagagccagctcaaaatgcaattccctaatccaaatgaatacagcgcattcatgggaacattctctttctggacaggggttgtatccgtattcgttatgctgttcattggtggtaatgttatccgtcgttttggctggttaacaggcgccttagttacacctgtcatggtcctcgtaacaggagcgatcttctttgctctcgttatcttcagagatcatgcaacaggattggttgcagctttgggaacaactcctttaatgctagcggttgttgttggagccgtccaaaatattctttccaaatcgactaaatatgctctctttgatgcaactaaagagatggcttacatcccattggatcaagagcaaaaagttaaaggaaaagccgctattgacgttgttgctgctagatttggtaaatctgggggatctttgatccaacaaggactcctagttgtttgcggaagcatcagtgcgatgactccattcctagcggtagctctctttgcaattattatggtttggttaacatctgcaaccaaacttaataaattgttcttagctgcttcagctgctaaagaacaagagctggcagaggccacagcagcagctgagaaggaagcttctcctgcagcgaaagaagtctctcctgctatagagggtgtttcctaa

SEQ ID NO: 48 - DNA, 477 bp, Chlamydia muridarum
atggctacggcacagattactatccaagaagaaatagagcagctcataactaaagcgattagcaaagttggaggaagtaaagaaaatgatctttgtcgttatctcccaggaccaacaggcggatacatgcatcatttcactttgaaaaaaatgaaacattccgctccagaacaactcttgaaaatgttgaagacatttgtaatagattccatgactcccagatctattaatcccaaaccaagagctccacgaggttctaaaaaacgaaaagattttgtgaatttcacgaaaacagatattgaacgcgttttagagctcgctcgtcaagttggcgacaaagatctcctagctcggtttagtcctaaaaaaccgcttccttctctaaaacgagaactcattcgctctatccgcaataatattgtaagtacagagctttggaatgcctatgtggaagcgctttctcaacctaccgaataa

SEQ ID NO: 49 - DNA, 981 bp, Chlamydia muridarum
atgttttttttgcatgttagaaaatataagcatgttattgggggactcttgtgtttagcaggttgttttgtaataagtagctgttcctctggcagaggaaacaaatctatcgatgaaagaattcacattttgtctatgaatcgcatgatttatgattgcgtttcgcgcataacaggagatcgagtcaaaaatatcgttctgattgatggatctatagatccacattcctatgagatggtcaaaggtgatgaagatagaatggctataagccagctgattttttgtaatggcttaggtctggagcattcagctagtttgcgaaaacatttggaggggaactctaaagttatcgatttgggggctcgattgttagataagaattgttttgtccttttaagtgaagatgggttccctgatccccatatctggacagatatgggtgtatggatttcgyctgtaaaagaaatggcttcagtgttggttcaacaaattcctcagtatgcggaagaatttcaaaaaaacgcggaacaaattctttctgaaatggaagatctggaccgctgggccgtacgttctctcgctaccattccagaaaagaatcgttatttagtcacggggcataatgcgttcagctattttactcgacggtacctatcttctgatgaagaaagggaatctgggaattggaaattgcgttgcatgtctcccgaaggcttgtctccagaagctcaaattagtattcgggatattatgcgtgtagtggagtatatatgtgcaaatgatgtgggggttgtcttcttagaggatactttaaaccaggatgctttaagaaagattgtcagttgctcgaaaagtgggcaaaaaattcgtttagctaagtctcctttgtatagtgataatgtttgtgataattattttaacactttccagcataatgtccgtaccatcacggaagaactaggaggaactgttcttgaatag

SEQ ID NO: 50 - DNA, 1860 bp, Chlamydia muridarum
atgacagtaatatattttgttcttgcagccctggccttaggctttctgattttaattcatgaactaggccatttgttagcagcgaaagctgtaggaatgactgtagaaagtttcagtatagggtttggacctgcacttgttcgaaaaaaaatggggagtattgaataccggataggggcaattccttttggaggatatgttcgtatcaaaggtatggacagaaatgataaagaaatatctgaagacagggagaaaacggtttatgatatccctggaggattttttagtaagtctccatggaaacgtatcttcgttttagctgcaggtcctctagctaatatactggtggccctatttgctttcgggattctctatttttctggaggaagaacaaaacctttttctgaacacaccagtattgttgggtgggctcatccttctttggagcaaaagggattacgtccaggggatcgtattttcttgtgtaatgggcaggtctactctgggaataagatggcgttttcgtcttctttgcttgatagaaaattatcattgcaaggggagcatcctgcttacttctctgaagcggagtcattttctctagacgtaccatttaatcctagcttagaaggagtcccttgtttaggggctagctatttactgtatcgtggttctgagcctttgcctgaaaaatctcctttgatagatgcaggattatctgaaggggatcgtctagtatggatggacggtgctttggtattttctggcgtgcaggtttctcaaattctcaatgagaaaaaagcttttttgcgaatcgaacgtcagggaaagatcgtattcgttcgtcaatctagggttttggcgggggatcttcagctcacttcatattttaagaatgagctgattgattgtcagtatgaggcggggcttaaaggaaaatgggcttctctatacatgttgccttacattattaatagtgatggttttgttgaaagtaagatcaatctgctaaacacggatcagcagtccttagattatcatctggagttaggagatagaattgttgctgtagatggaattcctgttatgagcaatgcagatattttgcgtcttgttcaagatcacagggtttctttgatttttcagaggatgtcttcgggacagctctctgttttggatcaaaaagctgcagacaaagcatttattgattcctatgatatggacgatcttctgcgtgttgcagggtctgtaggagaagaacgggaggtatctcacttaggagagtatcgtctggtaactcgagtacagcctaagccatgggtgcatatttattctgaagaattattagataaacagcgtgcccttgcgtctaaattccgagatgagcaagagaagcgctattacttagaaagaatagaatccgaaaaacagcgcatttctttgggcattccccttaaggatctcgctgtgcagtataatccagctcccttagttttgatgggagaatccatttctgatagcttaaggactgtaaaggccttaggatctggccggctgagtcctcaatggctttcagggcctgtgggaattgtccgtattctacatacaggatggtctatggggattcccgaggctctatcttggatcggattgatcagcataaacctagcagtattgaatctcctccctataccggttttggatgggggttatatacttttatgcttatgggagagcgtttctagacgtcggttaaatatgcgactcattgaaaaaggactagtcccatttatgattctgctgatcttattttttgtgttcttgaccctccaggatctttccagagttttcattggatga

SEQ ID NO: 51 - DNA, 1020 bp, Chlamydia muridarum
ttgccaagctattacccctgtccctggtggggtgggccccatgaccgttgccatgctaatgagaaatacatgggaaagttttttacgccatacgctttgatcatattcgttttcttgattcaagcctgctcttctccttcaaaaactatttttgaaggtgtccgcatgacaattccttaccgagtcgtgctcggggaaactctttccttttctcaaaaaaaacaagctcaaaaggaaatcgatcaaatatttgatcacattgaccaaatatttaataattggaatcctttctctgaaatttcgcgcattaatcgttctgaaactcttgaacccatttccctatctccagaactcttctcttttttatgtgaaatagatcgattccataccttttcagacggacgttttgatcctaccttaggagctttaaaaaacttatggctgcttcacttaaaatcacagactctcccccctcaagaactacttcactcgtataagcaaaacactggatggcatctactttctcttgataagaccaatcacacgctaaaaaaactgtctccttcagtccaattagatctctgtggagctgtaaaaggattcgctgtagatctgttaggaatattttgttcccaattttgtcaaaattattacgtggaatggggtggagaaatcaagacatcaggaaagcacccttctggtaggtcttgggccatagcatcatcagcaacgccagaaattcttcatctcaataatagctccatagcaactagtggaaaccaataccaacgttggtatgtaaataaaaaaatttacactcatattttggatcctttaacaggaattcctctagaagagagtagctatcctatcttagcagtatctgtaatcgatgaaaattgtgcttttgcagatgctatggctacagcattaactaccttcacctctaagcaagaagctcttgattgggcaaaaaagaaacatctttgtgtctatattaccgataagaacgcttcatag

SEQ ID NO: 52 - DNA, 474 bp, Chlamydia muridarum
ttgtcacgcgcgacattgttctctgtctctttggcaagttttctcttgtttccacgctattttcctgaatggcggcccgtatattttgcacctttggtcgttactactttttattcccatcctaaagaacgcgttcttctttgggctatgctttcaggtcttctttgcgatatgggatccacttgttttatgggcattcaagcctttctttatgtgagcacagctcttatcctttacaaaacacaaaagttctttataaaggagcgttggatctcacttcctttgatcagcgctctgtttgctctaaccttctatttgctctcctacccagttctcgcgtttttcaatcaccccctttgtctgtgcggaacagcccttctagctgatttacaacatgtgatcttagtagaccttccttatggagcatttctcagccttctgacccataaaacaccttttactccacagatctaa

SEQ ID NO: 53 - DNA, 402 bp, Chlamydia muridarum
atgcattttgaacgaaactataaaataaatagaaacacatctttattaactaaatattgtgcatcgattgatataaatcgcttcatcttttatattccgaaaatattcataataactctgttgaggctcttattcctcttactaaggttcctttcccgactatcttcggaatcttttctgaaaatttgtcacgcgcgacattgttctctgtctctttggcaagttttctcttgtttccacgctattttcctgaatggcggcccgtatattttgcacctttggtcgttactactttttattcccatcctaaagaacgcgttcttctttgggctatgctttcaggtcttctttgcgatatgggatccacttgttttatgggcattcaagcctttctttatgtga

SEQ ID NO: 54 - DNA, 1305 bp, Chlamydia muridarum
atgaacaaggatcttgtggctatttttgactacatggaaagagagaaaggtattcaacgctctacaatagtaggagctattgaatccgctctgaaaattgctgcgaaaaagactcttagagatgacgcgaatgtgtccgtgagtatcaatcctcgcaccggagacatagaagttttttgtgaaaaacagatcgttgaaaaatgccaaaatccaagtaaggaaattcccttagataaagcccgtgaatatgatccagattgtcaaatcgggcaatatatggatgttccttttgtctctgatcaatttggaagaattgcagctcatgcagctcgccaaattatcggtcagaaacttcgtcatgccgaacgcgatgtaatttatgaagagtatcgccatcgaaaaaatgaaatcatttcgggggtgattaaaagtttctctcgcggatcaaacttagtggttgatttggggaaagtagaggggttacttcccgctcgcttttatcctaaaacggaaaaacataaagtaggcgataagatttatgcgcttctttacgaagtacaggaatctgaaaatggcggagctgaagttattctcagtagaagtcacccagaatttgtaaaacaattattcatgcaagaagtcccagaattagaagaagggtctgttgagattgtgaaaattgcaagagaagctggctatcgaacaaaaatggcagtgcgctcttcttcccctcaaacagatgctgtaggggcttttgtaggtatgcgtggctctcgcatcaaaaacatcattcgagaattaaatgacgaaaaaatagacgttgtaaattattcccctgtatcgacagaattgttacaaaatttgctctatcctgtagagattcaaaagatcgctattttagaagacgataaagttatcgctattatcgtccaagattcggactatgcaactgttattggtaaacggggtatcaatgctcgtctaatcagtcaaattttgggctatgaacttgaagtccaaagaatgagtgaatacaacaagctattagaaattcaacgcttacagctagctgaattcgaagatcctcgattggatcagcctttagaagtggaaggaattaatacgttaatagtgcagaacttagagcacgcaggatacgacacgattaggaaaatattgctggctagtgctagcgaattggcttctgttccaggaattagtttagagttagcttacaaaatcctcgaacaggtcagcaaatatggagcatgcaaagttgacgaaaaacctaaagttgaagattaa

SEQ ID NO: 55 - DNA, 1611 bp, Chlamydia muridarum
atgcatggcttcaccgcgacagaagaagaacccactagcgaagtacagcctggtgcgatcctaaaaggtacagttgtcgacataagcaaagattttgtcgtggttgacgttggattaaaatctgaaggagtcatcccgatgtcggagtttattgactcttcagaaggtttgtccgtcggagctgaggttgaagtttatttggaccaaactgaagacgaagaaggaaaggtcgtcctgtccagagaaaaggcaacaagacaacgtcaatgggaatacattcttgctcattgtgaagaaggctcgattgttaaaggacaaatcactcgaaaagtcaaaggtggcttaattgttgatattggtatggaagctttccttccagggtctcaaatcgacaataaaaaaattaaaaacttggatgactacgtagggaaagtttgtgaattcaagattctcaaaattaacgtagatcgcagaaatgttgttgtgtctagaagagaacttctggaagctgaacgcatttctaagaaagctgagttgattgagcaaatcacaatcggagaacgtcgtaaaggtatcgtcaaaaacattactgactttggagttttcttagatctcgatggtatcgatgggctgcttcatatcacagatatgacatggaaacgtatccgtcacccttctgaaatggttgaactcaaccaagaattggaagtaatcatcctcagcgtggataaagagaaaggtcgtgtagctcttggtctgaagcaaaaagaacacaatccttgggaagatatcgagaagaaataccctccaggaaaacgtgttcgtggaaaaattgttaaacttctcccttatggagcatttattgaaattgaggaaggtattgaaggcctcattcacgtttcagagatgtcttgggttaaaaacatcgttgatcctaacgaagttgtaaataaaggtgatgaggtcgaagtagtcgttctctctattcaaaaagatgaagggaaaatttctctcggcttgaaacaaacagaacataatccttgggataatattgaagaaaaatatcctattggattgcgtgtgacagcagaaattaaaaatctaacaaattatggagctttcgttgaattagagcccggaatcgaaggattaattcacatttctgatatgagttggattaaaaaggtttctcatccttccgaacttttcaaaaaaggaaatactgtcgaggctgttattttgtccgtagacaaggaaagtaaaaaaatcactttaggcgtaaaacaattgactcctaatccatgggatgagattgaagctatgttccctgtcggaagcgatatctccggtatagtaactaaaattacagctttcggagctttcgttgaattgcaaaatggtatcgaaggactgattcacgtatccaaactttctgataaaccttttgctaaaattgaagatattctctctatcggagacaaggtttctgctaaggttatcaagctagatcctgatcacaagaaagtttctctttccattaaagagttccttgctcatggaggacatgctggtcaagatgcagaagaagaaacatcttctaacagagactag

SEQ ID NO: 56 - DNA, 897 bp, Chlamydia muridarum
atgttgaaaattgatttaacaggaaaaattgcgttcatagcaggtataggtgacgacaatggatatggctggggcattgctaaaatgttagcggaagccggcgccaccattcttgtgggcacttgggttcctatttacaaaattttctcccaatcctgggaactaggaaaacttaatgaatctcgcaaattatcaaatggagagctgcttactcttgctaaaatctatccaatggatgccagtttcgacaccccagaagatgtccctcaagatatcttagaaaataaacgctacaaagacctttctggctatactgtatccgaagtggtagagcaggtaaaaaaagatttcgggcatatcgatatccttgtccattctcttgcgaatagccccgaaattgccaaacctttacttgatacttcacgcaaggggtatcttgcagctctaagcacatctagctattcctttattagccttctttcccatttcggacccattatgaatgaaggcgccagcacaatctctttgacatatctcgcttctatgcgtgctgttcctggatatggtggcgggatgagcgctgcaaaagctgctttagagagtgacacaaaggtattggcttgggaagctggtagacgttggggaattcgcgtaaataccatttcggcaggacctttggccagccgagctggaaaagcgattggatttattgagcggatggtggattactatcttgattgggcgccactaccatctccaatggaagctgaacaagtgggcgccgcggcggcattccttgtttctcctttagctaatgccattacaggagaaactttatatgtagaccacggagccaacattatgggcataggtccagaaatgcttcctaaggattaa

SEQ ID NO: 57 - DNA, 1953 bp, Chlamydia muridarum
atgtcgttaggtattagtggcatttgttcttctttatggtctcgcctttttgggagttctcagaattttaatgttacagaggttgatgaagagcccatctctttggagtcaaatttctctgtacacactcaaccggatcctattaattcggtatgcgggcagctcccatgcaattttttgatggctgcccaggctcctaatgtgcaggggcttatttttcatgatcatggaagggagatttttggtagaaggtctcaggacaggtactcttcttcaggttttgctctaacttctatctcccttagaagtggcgattgtattgatagtccctcctccgaatctgtgatcgatcaacagcctcggcttggatcctcttcttctcagcatcgttcactacagttggctgcgatgctttctggcatgagctccttttcttctaagaacatttttagcttatttggagaagatcgtattcgctctttcacagaagtggatagtccatcaacagcttcattatctcagttaagaggcttattgaaagatgcaaacgtgtcagataccgtgtctttattgctcggattaaatggtatagagacttcggacatgtcttctccgctcgttaacttgttacttagtcagtataatctttctggagcagcgaataacaagaatttgaatgatcttgttgaacttttgcagaaggtgcaaaacaaagaaagttctgttgatgaagcttcaacgcaaagttgtttgagagtatgttgctccactgtttgcgggctgttagctagttcccctaatccgattgttagtggtattggtataggaggaacagcattaacagagcttcttgtaatggcagcaaaaagtcaacgggttcaaaaaagcttagagttgtgccacgattcttgtaaaccttgttgcactagatcttgcgggtgttcttcttgtggttgtgatggaggagaatgtggttgtggtagatttggaagtctcttatgtggttgcacagagttatggtgtttcaaagagtctgttagagaagaggttgatttaaaagattatgctaataagattcagcaattagaatctgctgtagggtccacaacgtttatgatgggattacagaatttagggattaccatctcagatttattgaacggcgatgttaaaaatattccttctccagaacaactagaaaatgcttgtaaagaggcggtatccactattgggcaattgatgatgcgtatgactcaagagaaatggatgaatcgtttttgctcttgtatgacgatactaaatcaatctttctggaaaggagctatttgttctggattatcgggaagaacaactatgctatctctagaggatctggccaatcgtgttaaaattgttacatgcactggaggcaaacaagaagctgagaattttaatcccgcattactgcttccagccttgtcatgtttgcagataaaaggaatggaggaagataacgaaaataacgaaggaaatggtttaagtgctgatcagaaaaccttacttctttgtaagctttgttcggttctttcctccgcagtagggaatgacagaaaacctatttggttaacgcctaaacaattaactgaaatcgtctgtgtttgcatgattatgtgcggaatttcaatagaaggaggtccgtctagcgaaagcgaagagtgtaaagagttccgagattgtattttacaagagagtttagattgtttgcgagatcggttacgatgttcattgcgtacaacaagcaaaactcgtagagatattcgtaagctagttgtagtccatgaatcacaaaatgcctttatagagttacttttagctttaaaagatcctgatagtagagagagtaaaggccttttaagagagtgtttctcctcctgggcaactaaagcaggagtggtaaaggttactgaggcttaa

SEQ ID NO: 58 - DNA, 756 bp, Chlamydia muridarum
atgaatgttgctgatcttttgcatgttttgaatgaattattatatcctgaattgtttaatgattatggccctaacgggttgcaggttggggatgcgcaggcaccagtccgtaaaatagctgttgcagtgactgcagatttagcaactattgagaaggctattgcttgtgaatcgaatgttttgcttgtgcatcacgggttattttggaaaggaatgccttatcctatcacagggatgctttatcaaagaatgcagcgtcttattgagaacaatattcagttaatagcttatcatctgcctttagatgcgcatccagaagttgggaataattggaaagtggctaaagatttaggatgggagcgattagaatcttttgggagcacgaaaccgtctttaggtgtaaaaggggtgttcccagaaataggcattcatgactttgtgtctcaattatcctcctattatcaagctccagtattagctaaagcccttggaggaaaggaaagtatttcttctgcagcattgatttctggcggagcttataaagaaatttctgaagctaagagtcaggaagtagattgctttatcacaggaaacttcgatgagccagcatggtccttagcacatgaactagccattaacttcttagctttcggacacacagctactgaaaaggtcggaccaaaagccttgactcagtacttgaaacaagtgggatgtgattctgttgtatttttggatacagaaaatcctttttga

SEQ ID NO: 59 - DNA, 1635 bp, Chlamydia muridarum
atggtcgctaaaaatattaaatataacgaagaagccagaaaaaaaattcaaaaaggagttaagactctagctgaggctgtaaaagtcactctggggcctaaaggaagacatgttgtcatagacaaaagctttggttctcctcaagtaaccaaagacggagttactgttgcaaaagaagttgagctcgccgataagcatgaaaatatgggcgctcaaatggttaaagaagtcgctagtaaaactgctgacaaagctggggatggaaccacaacagccactgttcttgccgaagctatctatacagaagggttacgtaatgtaacagctggagcaaacccaatggacctcaaaagaggtatcgataaagctgttaaagtcgttgtagatcaaattaaaaaaattagcaaacccgttcaacatcacaaagaaattgctcaagtagccactatttctgcaaacaatgatgcagaaattggtaatcttattgcagaagcaatggaaaaagttggtaaaaacggatctattactgttgaagaagccaaaggattcgaaacagtcttagatgtcgttgagggaatgaatttcaatagaggatatctctctagctattttgcaacgaatccagaaactcaagaatgtgtattagaagacgctcttgttttgatttacgacaaaaaaatatctggaattaaagatttcctccctgttttacaacaagttgcggaatcaggccgtcctcttcttattatagcagaagacatcgagggagaagctttggcgacattggttgttaaccgaattcgcggaggattcagagtttgtgctgttaaagctcctgggtttggagatagaagaaaagctatgctggaagacatcgctattttaactggcggtcagcttatcagcgaagaattgggtatgaaattagaaaatgctagcttagcaatgcttggtaaagctaagaaagttatcgtttctaaagaagacacgactattgttgaaggaatgggcgaaaaagaagctttggacgctcgttgcgaaagcattaaaaaacaaattgaagacagcacttccgattacgacaaggaaaaactccaagaacgtcttgctaaactttctggcggcgtagcggtcatccgcgttggagcagcaacagaaatcgaaatgaaagagaaaaaggatcgtgtagacgatgctcaacatgccacaatcgctgctgttgaagaaggaattcttcctggcggtggaacagcattaattcgttgcattccaactcttgaagctttcttgcctatgttgacaaatgaagatgagcgaattggagcccgtattgttttgaaagctctctctgctcctttgaaacaaattgcagcaaatgcaggaaaagaaggtgctattatcttccaacaagtaatgtcccgttctgcaaatgaaggatacgatgctctacgtgatgcctatacagacatgatagaagctggtatcttggatcctgctaaggttactcgttccgctttggaaagtgcagcatctgtagctggtctactattgacaacagaagctctcattgcagaaattccagaagaaaaacctgctgcagctccagcaatgcctggtgcaggaatggattattaa

SEQ ID NO: 60 - DNA, 309 bp, Chlamydia muridarum
atgtcagatcaagcaacaaccctcaagattaaacctttgggagatagaattttagttaaaagagaagaagaagcttctactgcaagaggtggaatcattcttcctgatactgctaagaaaaaacaagacagagctgaagttttggctttaggaactggcaaaaaagatgataaagggcagcagcttccttttgaagttcaggttggcgacatcgttttaattgataagtattctggccaagaactcactgtcgaaggtgaagaatatgtcatcgttcaaatgagcgaagttatagcagtcctgcaataa

SEQ ID NO: 61 - DNA, 1827 bp, Chlamydia muridarum
atgacgactgatacaacttctcaaacagttttacgctctagaaaagatgttccttcttctgattgttgggataccaaaagtttatatgcaagccgtgaagcatggaaaaaagatttggaaaatttatgtggtaaagaagctccattttggccacatctcaacgaaaagcaattccatatagaacagccatcctctctttataagttacttaccgaagtcttttctattgaaagaaccttggaaaaactctatgtctacgcccatctcactcacgatgaggatatatccaaccaagaggctacagcagaccttaagtctatcacctatctacttacgtcattttcagaagaaatctcttggattcaaccggccctcattgctcttcctcaaaaaatttctgaagagctacttacttctcccgaactccaaacataccatttctacctaaaaaaaatatttcgtttagctcctcacacaggcacttctcgagaagaaaaaattttagcatcttcttctcctgcattagaagtagcctacaaaacgttttcaagcttgactgattctgaaattccgtttggagaagctgtggattccgaaggaaaatcccatcctctttcccatgctttgtcttctctttatatgcagtccccggatcgagaattacgaaaaagcgcttatcaaaaacaatgccaacgttaccatgggtatcgcctatctcttgcaaacttactgaacggaaaaattcaagcacatttgttcaacgcaaaggcccataattataaatcttgtttagaagctgctctatttcaaaacaatattagcacttcggtcgtcacgacactcattgagacagtcaagcaacatacacatctgataactaaatattttcagttaaaacaaaaagctctgggactaccagatttccatttttacgatgtctatgctccgatagcagctagcgaatttgctcgccactactcttacgaagaagccgtctctctaatttgtgatagcttaacccctttaggagataactacgtggaagctttacgcaaaggtctcacctctgaaggatgggtagataagtacgaaaaccaaaataaacgctctggcgcttattcttctggatgttatgacagcaagccttacatactcttaaattacactggaactctttatgatgtgtctgtggttgctcacgaaggcggtcatagcatgcactcatttttgagtcacaaacaccagcaataccatgaagcacaataccccatttttttggccgaaatcgcttcaacattaaatgaaactcttttgatggaatttttgctgaaaaatgctccgtctaaggaagagaaaattgccattctttcccggtctttagacaccatctttgcaactctgttccgacagactttgtttgcagattttgagttagaagctcattctgcagctgaacaaggaatccctttaacagaagaatttttctcccaaagctataagaagctacagcatatcttctatggcgattgtgtaacatttgacgaacttagctccattgaatgggctcgtattcctcatttttactacaatttctatgtctatcaatatgctacaggaatcattgcttctctatgtttttccgaaaaaattctttctaaagaagctggggctcaagaggcctatcttacatttttacagagtggagggtcagatttccctatcgaaattttgaaaaaatctggcttagatatgacttcatcggctcctatgctcaaagcattttcctatattgaacggaagttagacgaacttactaacctactataa

SEQ ID NO: 62 - DNA, 2604 bp, Chlamydia muridarum
atggagaagttttcagacgcggtcagcgaggccttagaaaaggcttttgagttagccaaagatgctaagcattcttatgtaacagaaaatcatttgctaaagagtcttttgcaaaacccaggttctttgttctgtttagttatcaaggatgtgcatgggaatctaggactattaacttctgctgtggatgacgctttgcatagagagccaactgtggttgagggtgcagctattcccaaaccatcgccaagtttacagcaattattgctaaacgctcaagaagaagctcgaagtatgggggatgaatatctctctggagatcacttgttattagctttttggaaaactaccaaagagccttttgcttcatggagaaaaacagtaaaaacttctccggaagctttgaaagaattaatcatcaaattaagacaaggaagtcgtatggactcgcccagtgccgaagaaaatctaaaagggttagagaaatactgtaaaaatctgactattcttgcaagagaaggcaaattggatcctgtgatcggtcgagatgaagagattaggcgtacgatacaggtcctttctagacgaaccaagaataatcccatgttgataggagagcctggggttggaaagactgcgattgccgaaggacttgctcttcggattgtgcaaggagatgttccagaaagtttaaaggataagcatctctacgtgctagatatgggagcgctgattgctggtgcgaaatatcgaggagaatttgaagagcgtttgaaaagcgttctgaaaggagtagaagcttcggaaggagcatgcattctatttatcgacgaggtacataccttagttggggcaggagccacagatggggctatggatgctgcaaatttattaaagccagctttagctcgaggaacgttgcactgtattggggcaacgactttgaatgaatatcagaagtacatcgaaaaggatgctgctttagaaagacgtttccaacctatttttgtcaccgagccctccttggaagatgccgtttttattcttcgaggattacgagaaaagtacgaaatttttcatggggtacgcattacagaaggagctttgaatgctgctgtagttctttcttatcgttatattacggatcgttttcttccagacaaggcgattgatttgatcgatgaggctgctagtttgattcgtatgcagataggaagtttacctttgcctatcgatgaaaaagagcgggaattgtcagctttgattgttaagcaagaggctattaagcgggagcaggctcctgcttatcaggaagaagccaatgaaatgcaaaaagctatcgatcgcgttaaagaagagctggcggctttacggttgcgctgggatgaagaaaaagggttaattgcgggattaaaagagaaaaaaaattctttagaaaatttaaaatttgcagaagaagaagctgagaggaccgcggactacaacagagtagcggaacttcgctatagtctcattccttcacttgaaaaagaaattcgtttggcggaagaagctttgaatcagagagatgggcgtcttttgcaggaagaggtggatgagcggttaattgctcaagttgttgccaattggactgggatccctgtgcaaaaaatgttagaaggagagtctgagaagttattagtcttggaagaatctttggaagaacgggtggtaggacagccgtttgcgattactgctgttagtgattctattcgatctgctcgagtaggtttaagcgatccacagcgtccactaggtgtgtttctctttttagggcctacaggagtcgggaaaacggaacttgctaaggccttagcagagcttttattcaataaagaagaagctatgattcggtttgatatgaccgaatatatggaaaaacattctgtttcaaaattaataggctctcctccaggatatgtaggttacgaagaggggggtagcctttccgaagccttaagaaggcgtccttattctgtagttctttttgatgagatagagaaagctgacaaagaagtatttaatattttgttacaaatttttgatgacggaattcttactgatagcaagaaacgtaaagtaaactgtaagaatgctcttttcattatgacatctaatattgggtcacaagaattggcggattattgtgcgaagaaggggactatagtcgataaagaggctgtgttatctgtcgttgctcctgcactaaaaaattattttagtccggaatttatcaaccggatagatgaaatccttccatttgttcctttgactacagaagatattgtcaaaatcgtaggcattcaaatgaatcgagtggctttgcgtttgttagaaagaagaatttcattaacttgggatgattctgtggttctatttcttagcgagcaaggttatgatggtgcttttggggctcgtcctttgaaacgtttgattcaacaaaaagtggtgactatgttgtctaaggctcttttgaagggggatattaaatccggcatgtcagtagagcttactatggccaaggatgttgttgtttttaaaactaaaacaaattctgtggtgtag

SEQ ID NO: 63 - DNA, 432 bp, Chlamydia muridarum
atggagtgtattagactgttttgtaaggatcacttgtgcttagacaaggtgaccaatcctgtttgctcgttgatcaagaaaggaaaaacttgtgagaaagtgcagatggtcgctggttgtataggggtgatttgctccatggtttgcttagctttaggcatagccgcagcagggacaggtttgcttggtgcatttactgtcagtcttggtgttgtagcgcttcttttgggaattgttctgttttgtatgtctatttatgacgttttggaacgccatggtggcttaggatgtcccataaaaatgactagggaaccagctcctgaaccagctcctgaaccagctcctgaaccagctcctgaattatcagtgaaatttactaaaggcaaggatgggcaggaggactgtgctgttattgttgggtgtcgcaagtaa

SEQ ID NO: 64 - DNA, 831 bp, Chlamydia muridarum
atgacatcacctactctagttgagatgcctctatcttgctatcccccaacacataccagttcaacagcctgcacaaaaagaagctcatcactctataagccctcattaatagaaactgttcaacgagtggctgcttttgtttccttagctatcttaagcataataggctttctggctatcttagggcatgctattggttttctgatagctccacaagttgccctagttcttattgcggtatttatcatttccttattaggaaatgctctctacttatgcaaaacggctccattacgtctatacaaagagcttcaacaagaggttgcgtctctaaaagaagtaaatttcttgttaaaatctgttcaaaaggaatttttagggttatcaaaagatttcgcaacaacctccaaagacctctctgatgtatccctagattttcataatctcctacaagattttcaatcttcccatcaagggtttgaggacctactggaggactataaaaattctgcagaggatcttcgtcaaattttttctcaagaaaccgtgcagagtctcaaaagtactatcctatcattaaaagaagagataaaagagatcgtcccattgactgaggaagttcgccgtttggctgagaataaagaagatttactaaagattgttcaagatctgcaagatattcgagataaattacgagcagaaatcaataacctttcgcaagcctccaaaacattaagtgagcagatcgcatcgcaaatagaagaaaatgaaaaactttacgccaatataacaaaagcgctctctcaatcttattctgattcttccgcctaa

SEQ ID NO: 65 - DNA, 492 bp, Chlamydia muridarum
atggatttaaagcagatagaaaaactcatgattgctatgggccgcaataaaatgaagcgcatagcgattaaacgtgacggttttgagctggagttagagagagacaccgggccaaatattcaagaacctgttttttatgataatcgattgtttgctgggtttactcaagaaagacctatcccttcagatcaaaatcttggtaatccgattgtcaaagaagtaggggagaagaaggaagataaacctgttgagggagattttattgtttctccattggtaggcactttttatggggctccttctcctgaatctccggcatttgttaagcctggagatattgtttctgaagatacggttgtttgtatcgtagaagctatgaaggtgatgaatgaagtgaaggcaggaatggctggtcgtgtagaggaggtattaattaccaacggcgatccagttcaatttggttctaagttattccgtatagttaaggcttag

SEQ ID NO: 66 - DNA, 801 bp, Chlamydia muridarum
atgtccaaaaaatcggcttctcattcatcgagaccaacaaaaatgtccccagacacttcctgggaatctattgcccaagattacaacaaagcagtcgaccgagatggacacttctatcatagagaagtgattcttcccaatttactatctaaattacaattatcgccttcgtcatccctagttgatatagggtgcggccaaggagttttagagaagcagttgcctaaaaaacttccctacctagggatcgatctttctcctagtctgctgcgttttgcaaaaaaaaactccggttcaagatctcgtcaattcctgcatcacgatatgacgcaccccttaccagagacttaccataatcagttctcccatgccgtagctattctctctcttcagaacatggaatctccagcgcaagctatttcgcatgcagctcaacttctggctcctcaaggaagattattcatcatactcaaccatccatgttttcgcattcccaggctctcttcctggttttatgatgaacctaaaaagttgatgtctagaaaaatagatcgttatctctctcccttatcagtgcctattgttgctcatcctggagaaaaacactccgaaacaacgtattcttttcattttcctttaagttactgggtgcaatccttatcaaaaacccatctcctaattgacaatatggaagagtggacctctcccaaaaaatcgtctggtaagagagccaaagccgagaacctttgccgcaaagagtttccgctgttcttgtttatttcagcgataaaaagatcttag

SEQ ID NO: 67 - DNA, 843 bp, Chlamydia muridarum
gtgctttctcagcatattgaaagaattaggtctgggcaagtctttgctttcccgacggatacagtgtatgggctaggagtctcgtttctcatacctgaagctgataagcagttatttgctcttaagcgtaggaatcctcaaaaagctttatctgtttatgtttcttctcttgaagaattggagtatgttgcccagcgccgcttaggagaggcttcaattaagattgctcaaaaatttcttcccggtccactcacattaattaccaaacataataacccaagattttctcaaaaaacgttaggatttcgaatagttgaacatcccatagtgaagcaaattatccaagaagtaggtcccttgcttgccacctcagcaaatgtatcggggttcccttcggcggtttcttctgatgaagtaaagcaggatttccctgaaaaagatattttagtgatttctgggacttgctctataggattggaatctactgtagtagatgctgaagagcgtatcatttatcgagaaggggtggtatctgctgcggaaatagaagatgttttacaagcaaaatgtacttgttcccctagaagccagtcttttagggaaagtattcgtatttacgttgtaaaaaatcatgtggatttgagctcttttctctctgctaagctagccttcaagggagttatttgtcagcatcctcagccatgcactttttactcggttttgagacaagctttgcgatcttctactcaagaagtgatttttgtttatgatgaaaaaaatacggaatacccagttctttcaaggtttttaggagcaagttatgatagtggatatgcattgtga

SEQ ID NO: 68 - DNA, 1521 bp, Chlamydia muridarum
atgatcgatgttttaattatgggagccaatccttcaggattgattcttgccaacatcttacagcagcatggcatctgcattaaagtaatcgactcccgagatagcataacagccccccttgccattcctcgaccttctcttcccttggttttatcgtcatcttctttagaacttcttgataacatcaatcttttgggagacctgctggataaaggacgtaaattctttggtgcccgctatcattggaaacaacgtacggtgctctttaaatttaatcagtcttccgcttctcgttatcctttttcccttttgatttcttatgaggatttggttaaccatttgctccaagagtttcaaaaacgtggtggcgtagtagattgggcaacaagacctgttacccaagtcgaagaaaatctattcatagagagcacaaaaacttcctcgcaagtctatgaaaaacgggagatctttgctcctaagtggatcgttgcttgtgaaatggatgcggatccagatcttagagacttagtcaaaacacaaatcaaaccaaaaaaattccataaagaagctcttttcgtagattgcgaagaaggagaaccttttgaagaagctcatattcaccttcttcctgtaacgaaaaattttgctaactttgttttttacaacccatatagaggatctcgtcagctgtacctagcaaacacttctggccctctttctcctaaatttaaaaacaagcttttgtacacatatggtcttgcattagcagaaaaccctctttccatttctgcatcatttatgcaatatcctttttgccataaccgctacatttttttaggaagcgttgctaacaacctctccttttcttatctctctggagtgaacttaaatattcatgaagcttttaatttaggctggaaacttcttccagtaataaaaaaagcagcctcctctcaactgattctttccagagagttgaaaacaagtcatgtgttacctcattttaatgaggttcatcaaaaaagaactgcaaagcttcttttttcaaagatgtatactccagctttaatgtactactaccttaagggatgtcgacagcttgatacagcggaaggagaactatactacccctctcatcgagcttcaaaatacgaaactagtgatattattaaggtttctcctaatgataaagaaattcgcggacctaaaccagggtctcgcgctttagatattcaacttgaaactgcgggctatctattagattcgttaaaaaatgccaagcatttgcttattttctttaaggagcgtccagatttaacgcatgctcttctcgaagagtatggggaatgggtagatgttattgcaactgaaaatcctaaggtacatagactgtaccatgccaatcccgaatctttgtttattattcgcccggaccgttatattggctacagaacacacgcattcaaattgcacgaactcatttcctacctgctccgtatttttgctacagaaagtgtctga

SEQ ID NO: 69 - DNA, 735 bp, Chlamydia muridarum
atgggaattcttattgaagctcgtcatgtttcgaaaacgattaagcaaagagatctccatattgatattctgaaagaggtgtcttttcaattgcacgaaggagaggttgttgcgattaccggagcttcagggagtggaaaaagttctttgttacatcttttaggaactttggatcagccaagttctggacaaatattattttttggtaaaactgttcgtctcgaggaccttcctatttttagaaatcgtagaataggattcatttttcaaaatttctatttgttagaagatgattcggtgatcaataacgtattgatgcctgcgcgaattgcaagaaaagatactgggaagaagtctgaagcaagagaaagagcgatttatttattagaatctgtagggcttgtagatcgacaagaagaaaaaggttgcttgttatctgggggagaaaaacaacgagttgccatagcgagagctttgatgaatgatcctgagattgtattagctgatgaaccttctgggaacctggaccgtcgaacagccgatacgatccatgaacagctgctatcacttgcggggaagcatcgtggggtattgatcgtaactcatgatcgagagttagctgaaaaatgccatcgagaagaaattctccgcgatggcactttaacacagcgtagaaggggacccctccaggcttccttgaaaggtataggcacccttccatccgggaattattaa

SEQ ID NO: 70 - DNA, 9768 bp, Chlamydia muridarum
atgcccccttcagcaatttcaaaaatttcaaactctacgacgcctcaagttcagtcttcatcggctcctaaccttaccatgctcgaggggaagggtatttctgttgaaaaatccttcagagtttattctgaagaagaaaatcagaatcacacaacagaagatgttgttcgcattggtgcgatgctgcaacagcaattctataatatgacaactggacgaaacgagtcctttacggtttctccagcccatcattcaggtaattggaagacttctttgctttataattttgctcaactcgttgcgcatattttttctttgaatacggttccggcaaagattatccatcatgaaaatgggacgaaacagaattgggagagtaaacagcctacagtttcttcagaaaaaagttctaataaaagagatgtgtccgaatccatagctgtggttcagcgagtgaatccggaagtgatcacgaaatcttctttgaaagcaaccaagtctattaggagaagaaagcctcgatcggttgaagaaaaacgtgagcaacttgtaaaggatccagctgataagattgtatatgatctacgtgcagatacgatcgcctcgcgcttaaagttgactgaagagcaaattcagaagtgtcgaatttctttgaataatttaaaaaaggccattcaaagatatctcaatatagatgaatcagaaaggaattcgagaaaaggacaggatctgctagtcaaacagtccatttttcttaacaacattcttgaaaatgccaaaatggaggaaagtgaagagtttaagaatgtgatgtctgtcatcaaaactgaatttaattctcatcgagtaaaaattgacagtcattttcacggaatttggattgctggagctcctccagaaggcacagatgtttatatcaaaacttttctgcaaacttatgaggagtttgattttttattttgggtagatagacaagcttttggagcggctaaattttcctctattttaaaaaaaatcgcttttgattcttctcttaaggaattgagatcgataacttctcaagaaactcaagattttgtgaaagaatatgacgaactacaggcgaagtatcagacttctggtaggcgtgaagaaagacgtgaattggaaaaagatttacgtaagttatttgatcgctataagcaccttagccaagagatccgaacaaattttgatgctttgtttcttaaaaatatggtcctttcccaagacgggttttttaattactgccttttgaaaggaattggaacaattgatgaccaaactcgtatagcctatcttcaggatgagttacatcttcctgaagaagaaattcaacaatataaagatctaataaaggcgaatgagcaaaaaataaaagatattgttggtaaggtaaatacagacttagggaaagagagagttttcattaagaatattagggatctgtcttcaatgcaagatagaactaatacgtacaactatgaaatggagatgcttttgaggtggaattaccctgctgcttcagatcagatccgaatgtacatgttaaaagagttaggaggaatttatacagatctagacatgatgccgcaatactctccggatgttttgcaaatgattaatgagatcgggggagatagatttttcgaggaattacctattcgacgagcggtttcagatggggttttgagattagcaaatggtgagtcagggatcactattgataatatcgctcaggacattgatatctcaaagcttactagaagtgatagaacacaactcgaaaaacttttgacggacatagagaataaacaaaaatcaagtggcacttctaaattttctctattccaaaggatggccccagactctgttagagattttatgcctattttgcaaaggcatcataaatggtctacaggatggaatgtccggggcttaaatggattaatgatggctcataaaggaagtgctatggtggatgctgtgatcaagggacagcgtcaagcttatcgcgagctaaaaagtcttcgagaaactgttttaagcggcgaattttttaaaacattggatgatttaaaacatctcaatcacaaagctttgatcggagggcatttagtcgaagatttccttggtaaaagtcttttttcagagtttagacaagatacaattattgctggagctttaagtactttaggtataaccggcccagatttaattgtagacgaaatgaagacgtattttcgttctttaggacctattggaaaggactatctggaagggaaaaaattagggaacaaagctttcttaggttcgtataacaaaattgtaaaggagggtaaacaaacttttgactggctgcatcccgtaactgtaggagcaaatgatgttactcctgcagatgaaagcacctggtgtggaattaagcaaagatgtctggcagaattattattttctgacgaatccaaatttcgtccagaaactcccaagggcatttctcgaacgaaaattgacaaaaagacttttacaaagttgtggtctgaacaatctaagcgtgccctttcccccgagttgctagatcgattcaatgagcttatagaagccaaaaattttgatcttattaaatttactgacgtagatcgagcgttatacgttcttcgtaatcaagtgtgtgatgatgcttcagcaagtgctgctgtgttttcattgcaattgcaattagctgagttgcttcgagggacttctttccctatcgctaatcaacttaacgtattccccgacttaaatagaaatattgcatctagtcttgaaaaaacgattaagttgtacttacaaagccattctcaaacggaaacagtgatttggcatagcgccataagtgatcgggtaatgtttttaagggatatgttggctaccgcagagaggatgcgcttagttaaagagagtatcttttctaaagaagaaactcccttaacaactgaagaaataaagcttttaaattcttgggcagagctgcaatccaaagataacttgggtattttatctcttgaagaggtcgataaattgttagatgtaacctcttcaattatggagaattcaaaactaaaaaaacgcgtgtcagcaatagaagactccatagtagcaggctatttttatttaagattagaagaaacgctgtctgagtgggtacgtattcctccgaaagatctaaagaaaagagtcattcgatttatggagggaatggatgctaatcagcagcatcctgatgaacgaggaggacgatggtatagtcaactttatgatgagagcttcaaaaaacgggtaacagctcccgtgaaaaaaatacaggagttagcaaaaaaatatttaaatgaacagcgcgtacatgttcttgaaatagacgattatttaacaaagaatcccttgtttaatcgcctgcatgaggaaggttatgctttttctgatttaacagagatcactcggtatatgctcgccgaatatgggatctctgggattttttcagaagggaatattttgccttctccatctgctagattagtgaatattatcaaaacttatgtaggaggggattaccatgacatgcaagacgttcttcctaagatatatgactggttggcttctggaggtgcggcagatttaactaatgagcgttttgcagctattccagaaagtttaagaaaaaatttagaaggattacacggaacagatttattaacacctcctgttgacgctagcgtatctggatggggaatgagtttcggggtagaaaatggtgtagaaagtgaccatacgatgatcagcattgctccaggattctttaacggagcatcgtattctatgcagcattatttaagtgctttatatgaaattcatcggcatatccatttgggctcgcttactagtgatctgataaagaaagagttagaaagcaagggagctggttgttttgtacatgaagagcgctttgacagccttttaaaggcttcttcagagaagcaatatttatctttaacagaaatccataagtctctttctaatcaggtgcatttagcagaagctgtatcgcacttgatgaacacagctttgcctggggtagggaaaattattgaaagggagggagattttggccgcttgggcataacgacaacagaaacctcggtggctatgcgttcttatgattaccgggggattggagtaagtaaagacttgttctctcttccacaagaagtccccactatacagaatgtagtggagcaagccaagtatactttgttatcttggccagaattttataatcgctatgcaaatgcttggagtgatttagctactcattatggagcagagattctagaggctcatcctcagtcttttctttatgaggtggaggggcgctgcatgggattgtctctgttgtatatgtccatagaagatgagggaggctatagaactcttcaagggaacctagacactgtttccgcactatatcagcaaaaagaacgcgatcatcttcccctatcaagtaaggatcaatccttactaagtcgagacctctcattaattaactggctacagtatcaagggaataaagtcttactagagaataggggctttaatcacgctaaatgggacgttttgcagttaacgagtacgtttgagaaaagtctgactaaaagtcttcttataacaaccccgacacattctttaactctaaattttatggggtctttttttagagtaacagatcctaattttgggcatgttgactttccttcgctggcagcggcactttattttattgaagatatggtgcaagtgtcccctcacattaaacaacggtatggtttttcggaaaccttgtccgtaagagaacaactccaggtttattttttggatgctcctgagggaatacagtcattgttgtcttttaccgatgcgggacttttatccagtcatcaggcaactactttagaaaaaatgcgagaaaggggacctgttatcatagaaagaatccaaaccacttgggggaagctttatgaaataggaggttctattcatcatagaaggattgatgagttcacttcagaaaccgatttagatgaaatgaagttaaatggagatgtattaacagactttcttacaaaacatgttttagattctgaaacggtatctctgattctagttttattagaaacaagaggactagaagaaggaactaaacatgttagtcgttctttgattgtagagacgccagacgaggcagcatctctatttcaatttcttaagaataagactgctaaaacaagagagatgttagttagtttgttatctgaggtaacagacaagttaaaaagcgcgcaattagacggtgaggatgttgaagtctcaagggtcagtttttcagataattccgatgagatcactgttgaggtaaaaaaaggaagccttctcaaaaaactctcgatacgaggaggaggaatttttgactctttcaagcagtttagcgctaaggcgaatgaattaggcgctactggggttatggatttagagctcggaatgagtatagtgtccattgtgcaatacatgcgtttgttggaagaagggaaggggaaagatcccttagcggtagcaaacttagtaatggacgtgaaagaaactgcagaaatgacagtcggtgcggttatacagggtctttcaaaaaaatttattactcaagaaggagttgatgggttccgattagaaactgccatagcatctcagttaaaaaaagcttcatctagggtgggagggagtgttggaaaggttttttctaaaaccgcagctgttttagagcttcctgttcttgaaaccgcattaggagcctggaacttatatgacagcgttgtttctttaaaagaagctcaaacgcattctgaccgcatggctgcacgtgtggacattgcgtttaacagtattactttagggattacaatagcttctgttgctttaccctctttgatgctagctgtgggtcctttagctgccattggaatgggagcaagtgctattgcccgtaatgtagcgttaaaggaagaacgttacgatcagtggttagtatacaagaaatttctcactgaaggaggctctcacattttattcgctgatccggatcggcatttattagatttttctggcaattatgttttaggaaattttcttttagatttacgccaaaatccacctattcttaaaggagatcgctcttataattctaattggagaatagggaataaggctggttggacagactggcaaattcgagatagaataggttacggttatcgaatttctccgacgtcagcattagctcgagggcatgctaatagcttttggccgccagagttgcctactatccctaaaggggattataggacagttattttagggtatggcactacttatgaagccgtcacggaggtggtctatctttctaacaaggttgtttggagagaagctgtcatggaatcatcttctcgatattataggcctcccttaacagcgaaatcaaaattaagcaccattattgggggagattctccattaacagttatccctgtcagattgattgagaaagatgaaaaggaaaacatagatcatgctgcctcttataaagattataaaattaatatcaaaggagggaaaggagggcttactgtacagataggaggggccggtttttataatttaacagggactctccccgcaactaatacgatttctttccgagcaataccagctccttttggcgttaagtttaatctttcattagtagaacaagatgttccgctgataaggccaaatggcacagaagaaaagtttttaaaaattcgtcagactggtttcaatacgattttgggttcgagtgaagggaatgatactcttacaggagggaatgacacaaaattttattccagccctggaggaggaactatttattcaggtaaaggaaaggtagaatatcatattcctcagttaacgcatcctcttcatattattttatctaaaggttcttctgcgcatcagcttgttactgagataaacgcagaccaggtaaaacctgttctcggtagtttaagtttaacaagcagcatggagcttatatcaaaacaagagattcacgtttctagtgaagacactaaggaagatcttggagtttggaaagagcgctatgaggtacgtttaggtgatggaatcactgctacacccatagatcagatgaatgcaggaactagactcgtaactatgggagttaaaacgtgtgatgtagcgaagtggcaaaagcaacacccgacagaaacaagctatccagaagatattctcgattggttaacacaaaaatcttggtttttggctcccgaagtcttatttgttcttgaaaatgggacagccaaatttataactaaccgaaaacatattgtatattctccaaaaccttactcagagttagcggtgactcaatctagagacatcaaagccttcgtacaaggaaatactgggtgttcctatgtattctctacaatttatcgtagtagccaaaagactcaacagacagaactgactctagtagatgatgatgtttatgctcaaaccatagatgtaagttccattctaccaactcttatattagctaagaaatctggagacaatcaaatagattttgagttctcgtcttcgcatcatcttatggctattcgagtcagttggaaaggggttattcctgagagaactcgtgtaaaaattaataacgaaacaatcctgcgattggggtggctgaatgcaaaacttatggcatctagaaacccaagttattggaatctgctttattataacaggaatgttatccctgagcgggttgaggatgtgaagagcctcaataataccgtaattttaatgcctcccaacacaaaaagaaatggtgaacatgtgttcgctatagaaaatcaggaaggcgtagatgttaaagtattaggatttttgcaatcagggcatgttttaggagaatatgaagaagatttgatgtacaaagatgtttttgcccgaaagattacccattttgcggtaacggtacccgcacataaaacgaaatatcttttctttacagatgaggagtctttagctaatccggaagataatgttcttttttatagtaagttaggttcgaatactctccaagctagtcagaaacctttaacacagtttgctagacaattgtgggcatcttacgatgagatcagcgtaagcgatacttcattaaaattagaaaattttgttcgctacttaatggaagctgaaacaatagagttatatcggcagcttctgtatgcgcaaaatctcttaagaattcataatagagaccttgtcttaaaactattttatgttcgtcaatctgaagggatgggcgcagtactcatcacatttaaaaactttttcatagaatccatggaggggatttcagcgcctactttagagagagaagcgaaacccatactggcttctgatcctatgggattaattaatcctgcatatagagaacatttagatcttttcctaggtgaagacaagctcaatttagcgattttagttcaagaattcagcatgttgcagtacatcgtcagcatgcaagaaggaaaagctcttggatccttacttacacctccaagatataaggatatgaacttagctgtgctcacatatacagtggcttcgtcttgggaaggtagaagagaggcctcttggctaaaagctcctatagaatacaaacttcctttggaaactacactgaccgcatcctattatctasatcctgtaagtggggatttatatgtcacctgtttaatgaacagaaggcctcaaaatcaggcgtttgttatcagatttaaaggatataaattccagaaaggagcttttcgttcaatagcattgatttcttcacatagtgttggtgaatctcggatcgcgaaaactgtattgcaatttcgggggcaagaattattccatttagagaaatctgctccaaataagagtgctgttttgcaattggatagtaaattactttccctatctagaatgcttttttatggtggcgatcaggtcattcggtacacgccgctttctgtacaacagttcctctctctagatgacttatggttagctgatcttaaagaaagagtaatgaatgctaatgaagaagggtttaaactaatctcgcaaatgcatgacagttatttaatggaatcctgtatgaatttgcgagatgccgtacctcaatggaaaattaatccaaatgtaataaacaatgcgattacctattatagagtggtagttcctttctggattcgaaatcgattaacgaaaggatccttaattcgaattcctgctcacagtattcctatagctttaacaacaacgcaaaatgatgttttcaaaacaatttatgctccaggatttagtatttatttcagcttcttaggattagacgcattcttgaaacctcgtactcataatagggttggggatatgctccttgagctggaaaaagaggttgttgtgaccgtcaagaaagttgatgaaacagattataataagaaaagggtctatattgttacggaacttacaaaagaagaagaaagagttttaaaggccaacaaaaacgtcattacgattccaatgaagtcttcttacacaaagaaataa

SEQ ID NO: 71 - DNA, 10008 bp, Chlamydia muridarum
atgcctgtttccggttcaattgttgcatcgaaagaaaatacttctgcgtcattgcaaccggctacaactcttaataacggaagttctgtagaattcttccaacaaattactgtatatgatgacgcccgaaattttacgaatcatacaacagaagatgtgattaaaattggggaacagttacaacgtaagttttacaatatgacagaaggaactcaagttccttttacaacctctcctgcttaccataccggaaattggaaaacagcttttatctataacctggcccaggtgatagcaaatctttttccttcgactatacaacccatccgagttaattctactagaagctcaccattttcaactaactcctcagtagaaaaaagaaatcgcttcacttctaaagatacgaaagtccaaccaccacatacgacacggtcagtctcgccccgtaagagaaagtctgtaattgttactcgttcagtaaacattcataaccacacaccagataaaaaatcctctggggaatcccttcgtaatatttctttggagaaacctgttttatctaggaaaaggcgtgatgtagaaaagaataaagaaataaagaatgagccgtctgtcaataagtatgatcttacatataaaaacatagcggaaaaactagggctctcttctgaacagcaaacttctgttaaggagctattaaataagcttagaaaagctattactaattacaatgccctgatcgaaaaaaactctagtgaggggcagtctttactaattaggcaagccaagctagtggaggaaatccaagagaagatttctcctgcagtctcagataaaaagggcaatgagaagaaaactgaagaaaagtctaaagtatcttttataaaagatgttgctgacatcatcaaagcagagtttagcgggcaccttgtaccagttgataaaattattcatgggatatggattgctggagctcctccagagggcatagaacagtatatgagggtattcttagatacctatccagactattctttttacttttgggtagatagtaacgcttatggggcagctaaattttccggaattttgaaaagaatggcttttgacgtagctattcaggaattacgagattctacagaagaatcaacaaaagtctttgttaaagagtatgacgatttaaagaaaaaatacgagcaaagaattgcacaaacccattctacaaagaaaaaaaatgaatatctccaagatcttcaatcgcttttagaaaaatataaaacagtctctgatgaagttcgtggacgattcgacgtcctgtttcttaagaacgtagtaatcactcaagataacttttttaattactgtttgttaaagggtgtgggcaacatttccgatgaaactcgtatggagtatttggaaaaagaattgaagttttctaaagaggagatagaagaatacagaaaacttaaggaaagtaacaaggagaagattgcttctgttgttaaaaaattaaatgagcagcttggaagtgctcgggtccacattaaggatattaaagaacttaattccatgaagcactcccaaaatatctacaattatgaaatggagatgttccttcgttggaactacgcggcagcaacagatcaggtccgtatgtatatgcttgaagagtatggaggactgtatacggatttggatatgatgccagctttttctcaagaggtattagaagttataaagaaacatagtgttggcgaccgtatgtttgaagatatgacttctagacgggctatttctgatgcagttttaaaactagccgtgggggaaacaacaacggtctctatagaggatattggaaaggacatagatatctctcgcttaactgaagaagacaaaacaaaattaggagaattatttaaagagttagaattttttgtaaaaaaagatactcaaaatagttctaaactaggaaaagctaaaagtttctttcagccaatgaatatggatattgtgagagatacgatgcctattttaaggcgttatcattactatcctgagctaggttggtttgttcgaggcttaaatggactaatggtttctcataaaggaagtgctgcggtttctcatgtgattaaagggcagcaagatgcttatcaggaactagcggcaatgagacaagaagtcctttcaggagagtttttccgttctttagaagatctaacgcatagacaacataaagatctcattggtggccatcttgtctcagactatttagcgaagagtcttttttttgattaccgacaagattcgattatgccggaagctgtgagtacgttaggtataacagggcctgatcttgtagcgcaaaagcttgtggaattgtttaaagattggggacctctaggacgcgattttttaactcctagagggaaaaaacttggagatatggcctttttaggttcttataaaaaaattccattagatccttctgatcccagaaaatataccttcgattggatgaatccactgaccgtaggtagcaatgacgtaactccggctgacgagagcacttggtgtggtagtaaaaaacgatgtgtggccgagttgctcttttctgattcatcaacaaagttaagtacaaataaacttcaaggagtaactcgtacaaagatagataccagtacgtttacttctttatggaaagaagaaagcaagaaaaaacttcctcctggattattggaaagtttcaatcgttttattacagaaaaaactgttgatatcctaaaactttcagagttggatcagaagatttatgtaactcagtcagctattcaagatgataacattgctaaagcctccctattttctctgcagttacagttagctcatttattgcgttttgctccatatccggttacgaatcatgttcatttcttccctcaaattcaaaaagagcttgatagcgattacgtaaaagccatcaagctctttttgaaaacatcttctacaactacagtagtcttatggcacagctctcagcaaaatttaagcttattctttaaagagctattagcgatttcagagagaagggttgccatttataatctgttaaatccagaagaagctgcaaaagcaagaaaagctttagaaaaaaaggagcgggacaagaaagggaagcagcaagaaaaagactcttctgaaggtgaagatcaacaaggagatcaaaagaaaaatttctcagaatatgcagaacttttgaaacaatacgaacaacataaggctaaggatagtcttggcttgctatctgaagcagagcaaatgacttttcttgagatcacaacgcaaatcgcagaaaatcccacgttattttctgtaattagccaaatagaagcagaaatttcgtcaggatatgtatttcgagctttagaaagtcaagtatcgaaatggttttctcttccagagcaacaacgacgacagcaaatactaaatttattgaaagagctcgaaaaggatgccattaaaaattccaagcaagataagaaggatcataaaaattggctagaaaccttgtacgatcaggcagaacagaaatggttgcaagaaccgaagaagaagctgcaagatctcattaaaaattcaggtgacaattcaagggttattttaaaagactccgatcagcttctatcaagaaatgaactatttcagtccatgattaaaaagggctatccctttgcagatttcgcgaatattctacgtttcatggtagccgatgcgggaatttctgggattttttcttcaaaagctattttcccagccccatcaaagcagctggtcgatcttttaaaaaagacattgggaggcgattttgcaacactccaagatgctctaccaactgtttatgattggattttagaagaacctaattctgaacgaactaataagttattcaagcaattccctgaaaatttgcaaaaagagcttaaaaatatagccccagagcatcttctgacacctcctatagatacgtccgtatcagctttggggatgcgtttttccacggaagttggtttagagtctgatagtgttatggcctctataggtagtggatttttcaatccatcttcttactcaatggctcgatatatggaggctatttttgaacttcagcaaaaaattgtgaatggggagttacaaactgtagaaaccgttaagaatattttgcagaaaaaaggagcagaatccttgtatcatgccgatagagctgctttgttagtgcagttctcggaactaagatatcatctctctttaacagaggtacaaaagggattagctgatctcgataatttaggacaggctccctcttatcttcttactggtccattgccaggccttggacacatcatgctacgagatcgagattttgggcttcctttagcaacttctatgacagatcctataggacttagtacctatgatttttccggaataggggggagaaaagatgtattttctacaccatcggaagtaccatctattcatacgattatagatcgtgttaagtatgataccttttcgtggacaaagttttatgaacgttattcgggaatttggggagatttagcttttcgattaggagctgagtcattgcgaacccatcctcagacgtttatctatgatacggaagggcgttgtatgggcctttcttatttgtttttagccgctgaaaatatagctgcttatgggattttgcaagacaatctatccactttatcagcattatttttagaacgtgaaagagaaaagcttccgttatcccgagaagataatagatttttagatcgtgggctcgctcttatcgaatggttacaacatcgagggaatagtgaattgcaagcagggggtattttctctactgtggattgggatattccctctttaactaaactttttgaaaaatcttctgttcctggtgtattggtgaccacgccttcacatgcagtcactctccacttttttgatggggcatttcgagtaacagatcccaattttggacacgtagattttccttctttagaatctgccctctactttttggaatatatggttcagatctcttcagatgttcgtgctcaatatggaataaaggaaggtgtctccgttccccagcaactcaaagtatatgttccagatagtattgaagctcgtaatgcttggaatattcctacggatgcaggattagtaaccggttatcaaatgactacattagatcgcatgatagtcagaggagaggcttctttttcaggaatccgaacaacttgggcaactctatttgcaatgggattgactctaaatggtaaccgcattgatgaaagaactaaagaaagtgatcttgataaaacacaaataaacggagaccttttaactagctttttatctaaaaatgttcttgatgaacgaggagttgcattaggtagaaccttagtagaaacattaccttttgttgcagggactcgtttagtcagtagtggagctattgtcgaaactcctaatgatgtagcttctttgttacaggcatctagagaaagactgagccattttaaagatgttatccaagtgcttttacgagaattggcaacaaaaattcatggtaaggggttaaaggattctgacaaggtatcagtaaaatcagtaacagtagaaccttcaggagaagctgctattgtcttggaaaaacaagatacaccaaaaaaaacttcctcttatacgatttctgtgaaaataaaatctctaagagatgcttttcaaaattttgggaaaagtttaaacgaactggcaaacactggggtaatggacgttgagttaggcctttcggtgctttcattaatccaatacgctcgattagtggatgctgggaaagggtcttctcctgaggcactctttaatcttattctagatgtaaaagaacttacagagatgactgtcggaacggtcattcaggcactacaaaaacaatttattactccagctggaatagatggatttcgaacagaaactttattagctcggcaaatacaaaaagttggaactcgtgtaggaggaacggtagggaaagctttaggatcggttgctagagttttagaacttccagttttagaaacgatagccggggtttggggattagtttctagtgtagaagaccttttacatgcagattcttatagtgatagagtggcggctaaagtacagatatcctttgatgtcattacattagccctaacactttcttctgctttagctcctttagccatgttagctgttggaccaatagctgccattggaatgggagcggcttctatagcaagaaacgtagcaagaaaggaagagcgtcattacgcttgggtagaatataaacagtttttagattcagcagccaaacttgttgttaaggcttacccggagagtcaccttttagatttatcagggaaccgagtattagggaatttatatcttgatttaagtcagaatccacctcttttaaaaggggatgtttctcgtaattatgattcgctaattggacacgttggggattggtcagacaggcaagttcgaaatcgtttgggatatggatatcgaagcagtccagaaagagctttagcaaagggacacgctaatactagatggcctagagagatcccacatattgctaaaggggtttatgaaactgtttatttaggatatggtatccaatacaaagtgtatacggagatcgtttatctttctaatcaggttgcatggcgagatgcagtaatggatcctacatcgcgctattatatacctcctttagttgaagaaggaaaaagcgcaacaattatagccggaaatacgcctttaaatgtaatcatgttgcgtcttttggacgaagatactccggccagaattagtcaaaaccttgcttataaagactataaaattaaactcgttggaggaaaaggtggcttaacagttcaaataggtggtggagggacgtatactctaacaggagatgtttctgcaaaaaatactatctcttttcgagcaataccacctcctttgggggtatgttttaatttatctaatcatgccatgcaaaacgttcctatgatgcgtcccaatggcactaagatagaggctttaaaaatccagcagacaggattcagtgtgattgcaggatctgctgaagggtatgatatactaactggagagaaagatactcacttctatataagttctggaggagggaaaattttttcaggtttagggaagaactggtatcacatccctaaacttaaaggaagattagatattattcttgccaagaactctgctgagcatcttcttttgatggatgactattcatataattggcaatctcttggtacaaatctcactcttattcctagaggagaaggaaataacaattcagggatatttgtttcaaattttgatgcgagcccttcctttgaacaatgggtaaataaatttactgtaaaaatggcagatgggattactctttttgccttaaataaatcttcagaggaccaaaatttttcgttagcaactactaatacaatagtgactttaggggtgcattcggtagatcaaactatttggtcaaatcgtttacctgaagagccttcttacatagaaaatatttttaattggttgaaaaaattttgttggtggctagctcctaaggttaccgttttacaacgtgaaggaaccgcagatttttattatcgtgatcaaaaattgatctaccatccaaaaccttttgctgaactagatcttcatcctcaaccaggatatcatacttatgtaaacggctctatcggcgatacgtacatattctcagagtctccctgggttaatctttctacagtgaaattgtcgttagcagatgatctagggcattcacaaacagttgatttaagttctcttgttccgacttttgtacgggggagaatgaccagccaaactgtaaatgggccctctattgatttggaaatttcttctcctcgctacacacttcctttacagataagttgggggtctcatgttttgcctagaaacacccgatttgatgtgatgccaaatcactctccaacgttaggagaatggtatgacaagttaaacacaaatacttctgaatggcacacgctattccacaatagtatgttgattccaaaaagtctggtcagtgtattgagtttgaataataccgtaacggtgatggtgcgccatctagaaagaaagaatgagcatattctaggggtagaaaatagagacagtatcaatcgcaaagtacatggacaactttatgcaggctttatcacacatactatagaaaatcgccactggtatacgttgcaacctaacctagttgagttcgatattactgttccagccaagtccattaaatattttgtgttcagagggaggttgctattccgtagctatcttgagcccaaaactctagaggtaagaagtggtacgccaattgatttccatgtctggtcacaatatgataagatccacgtacatgcaacaacactaaaattagaaaaattccaagtatataatgtaactaccgcgacagatgcgttaaacagatacttaatgtatgcgcagaaccttgcatatatttatggtagagattttgttctgaagttcttctttattcgttctggaactggaattggcgccattcaattggtatttaaagacctatttaaggatagtttcggaacagaaaaaactttggggaaagaagctaaatctaccacgccgttatactcaatcataaatccttcatataaagatcacttgaaattcttcttaggggaaggagagtatgatttaacacaatacattcaagagattagtgatacttcgcatattattgaaatgttgcgcgacccaacaacacatgaattacaagagccttcgcatctaccaaaaaatcctattgttctaacttatacaattgatccccagaaagatagtgctggtggagggaaactacagtttttagataaaacaataaaagcttatcaattgccattcccaacaatggcagagcactattattacatggatcctgtgagtggggatttatatataacctgtatagctctgacaaacccagtagaaagagctttctcattgagactccccaaattcaaattgaactggttagagtttcagaacatttttatttttggaacccattctcgtacatcacaagctttaggatcttcagggacaggcgttatgtttgttgggcctgagattctgtatatggaaatagatctttcgagagttattgctgatcgttctttccctgatagagtttcatctagatcgagtgtcgtattcccaacaaatgatcaagttgtgctgtataatccatctcttgcaaagaaattctacagctattcagaatctatgatttggaatctgcgggatagagcaaaaggggaatcggatagagcaaaggcttatgacatctatctgctagacgcttgcacatctaaagacaagaaccttaattgggcaattcctccgaaactcttagactttgccttagcctattatcgggcatgggtaagtcattgggtgaaacaatccttgaaaaaaggctatttgattcagttgcctgctggcagcattcaagtatcgttaattacaacacagagcgaatatttcgcgcgtcaaagaaaacaaggattccaagtcttttatagtatctatggattacaagggaaagtgattcctaagcaatttcctggagatatgctttgtgatatcaaagaagatgtagtattgacggtcaaagccgtggatgaaagtgattatgataatagaaaaatttatgttgttttagatttagcaacagaagaagagcgtaaattacgagcagataaaaatgtcattgtcattcccggaggagaacagtcgaaatactaa

SEQ ID NO: 72 - DNA, 9678 bp, Chlamydia muridarum
ttggaacaagcattgtgtactatgactctttcgaatacagcctcttccacagtttcacctaagtctacgcaacttaaccatactttatccaatcaaactcaccctgttgctcaaagcaataggaatatagatttccaaatctatgatgaacagattcataataatcattctacagaagatgtagttgctataggacgtcgtattcagcaagaatatgcgaatcttaccacatcaaaacaggttaatttctcggcatctccatctaaccatactggaaactggaagatttctttgctttataatttatcgatgctggttgcaaatctattccctacaactattcagcctgtgcaacctcaaaaagtcatctttaagaatcaagactcttctaaggaaacccaactgaccaaatcatccaaagtagtttcttctcgctcttctttaaaagagattttttcgaagaaatctcctcctttgagaaagtctttttcttcctctaaaatttctagagcaatccctagaagaaaaaaacgatcaaacgatgatccagttcaagccacaaatacttatgatttgaccgctgaaaatattcttgaaaaactctctttaacacaagaacaacaaattaagcacgataatctgattagcaatctcaaagaagcaattaatcgatatagtgatcttaatcggaaaaattcccggaaaggacaatcccttcttgttaggcaagccaaaattctagatgaaattctttcacagactaaatctacagaggaacgagcttccaattctgtaatgacgactattaagaaggaatttacctcccaccgcgtacctgtagagaaaaatattcacggaatttggattgcaggttcaccgccagaagggaccgatgaatatattaaattgttccttcacacttatccagagttttccttccttttttgggtggataaaacagcttatggcgcagcaaaattctcttctactcttaaacgaattgcttttgatgcagcagttaattccttacgagaggctactccagagcctgtcaagcagtttgttcaacgttatgataagctaaaaaaatcatacgatacttcgcgagattttgatgaaaaacagcggttatctgagcagttagttgagctatacgataattacaataaatttagtaaggagattcaaagtaactttgatgttttgctattgcatgaaatgatcactattcaagatagcttttttaactactgccagctcaaaggagtaggtgcaataacagatgagacacgtatagagtatcttgagaaagttttgaaagtaaaagaagaggatctatctcactataaagaaactatcaaacgcaacaaagagtctattgaaaaacttgtaaaagagattaatgactctactggacgggagagagtagttatcaaagacatccgagatttgaagtctttacaagatcttactaatagctacaactatgaaacagaaatgttactccgatggaattatgcagcggctaccgaccagcttcgtatgtacatgcttaaagaatatggggggatttatacagacctagatattatgccacaatactctcaggatgttttgcaaaaaattatggatgttggtgggagtaggttttttgagcatgataagttacggcggactctttcttttgcagctctaaaattaggaagcggtaagcaaacaactgtttcctttgaagaggctaaaaaagctatgactctccccacatttactcttcaggataagagtcaaatttctgaaatttttaaatatctagaaacggaaacgcaagcaaaaaaatcacttttccaaccgatggatgttaccgtcgtccgtgatttcatgcctattttacaacgttatcataagtggcaaacaggatggaatgttcggggattaaatggtttaatgatggctcataaagatagtgctgttgtcgatgctgttattgctcgccagcgagcggcctatgatgagatgcgtgcacttcgtcagaatgttgttagtggagaattttttcgttctcttggagatcttgaacatgtaaatcgtgaaaagaatatcggcggctatttagcgaaaaattatcttgggggcagtctttttttcgattttcgtcaagattcagtgattccaggagctattagtaccttaggaatttcaggtcccgatatcatcatggataccatgagcgattattttacaaatcttggaccagttggagaagattttttatatgaagggaaattaggaaaagcagctttccttggagcttatcaagcacaaaaaactccgaaaggagaacttacctatgattggctccatcctttatccattggagctaatgacgttactcctgctgatgcaagcacctggtgtgaaactcgacagcattgtgccgctgagcttcttttatcggactctatatcctcagacgaacaccctaagggtattcgtcgagaaagagtaaacccgaatgatttctctaaattatggagtaaggaagctcagggaatcctttctagtgatttcgcggatcttttaccacgctttaacttactgatagaatcatctgcgttagatattcatactttatcggctcttgatcgagatatccaacacctttttacaaaagttcaaaaagaccctgtagcatctgtagctgtattttctttacagttacaattagctgaaatgattcgtgcgattcctttccctatacgtaatcaggtacatatcttgcctgaagcacaagcacatttcgaagcagattggaagaaagcaatccaattatatcttcacagtcatccccaaacagaagtggttatttggtacagttctactcatactcaaattgtttttggaaaagatttgcttgctgttgcagaacgagttgcagcagcaaaatccttaatgtctgatcatgatccatcacttataaccagttatctaaaatataaaactcaatctcatcttggggtgcttactgagtttgatcaagaagatttctttgaactgatggtagatattgcagaggaaccagagcttcataaacaactattgaaaatagaagaacaagttaattcaggactctactctcatgtagagcattctttaggagagtggttaaaattatccaaagaagaaagaaaatcaaagtttcttaagattttaaaagaaacgtttcaagaggaggaaagagaagactctcaacaacaacataaaacatggtttgaagaactctatgagaaaagacatcaggagcgcgtaaaggatccagcaaaaaaaatccaagaactaatcacagtttttcaagaaagtcagcgcgttcaagctcaagacatagatacttattttgctcataaaccgttttatcaagatctgatgaaagatggttacgcttttgaggacatttctgtgattacgaagtatcttttagcgagtgacggtgtttcagggattattactactgatcctatatttcctcctccatctaaacagctaattgacgctatgaaacaatctttgggagaagattttggtgagctacactatacgttacagatggtctatgattggttatctaaagagactaacagcgtaacttctgaacaggcaaaacaaaaattaccacagaaactacatgaaaaactagaaggttatacaacacatgatttgcttattccgcctattgatggaagcgtcagcgctttaggattgcgattttccacggaggaggggaaggtatccgatcgcgttttaacaagcatagcacctggagttcctaattctgctagctatgctatgactagttatttgtatggtttgttcttaattacgaaagatatccaaagtggtcgattaacccatgaaatactaaaagagagattacaaacctatggaggcgcctattttatcaatgaatcaaaaattgatgtgctacttgctttatcccggaaaaaagctcagatatccctaatagacgcccataaggctcttacaggtttttcttcttttagcgaagcatctctggctttacttacaggaaggatgcccggaacaagcagagttctatcaagagaagtagagtttggacgaccttcagctatcgttatggaaggagcaacagctattcgtgctcagagttacgatgctgttggattaaggaaagattttttcttgttacctcatacagttccttccatacagtctattgttgagcaagcgaaatatacagtattatcctggccagaattttatgaaaatcatgcggataaatggaacgatcttgctaatcgttttggagctgaggaccttagtgttcatccgcaaacatttttatatgacacagaaggtcgctgtatggggcttgctttactgtatatgttagcagatgactctgtatcctacagattattacaacaaaatctgatgactttagcttcgttatttgatgagcaaaacagaagaaatatccctttaactccagctgatcagaaatttttaaataaggggctttctttaattgagtggttacagttcaaaggaaatcaacaacttcaaacagagggatttttccataccttagactgggatatccctcaattaatgaagcactttgcttcttcaactgtaaaaagttggttaattactacgcctgcgcatagtcttgttctttctttaatggggaatttttttagagtaacagatccaaactatggccatacagactttccttcattagaagctgctattacttttttagaaaggatggttcaagtatccccagctgttttggagcgttatggatttgataaggaaaagtctgtaactagccaactcaaagtccactctttagagacttcagaattgcaaaatgcagtttttgcttcctcagatcttggctttactagtcgctattttacgacaacgttagaagagatgaccgtcagaggccctattacgatgaatcaacgtcacacggattgggccactctttataagattggggggactgttcaaggtaaacgtattgatagtagaacacgggaatcggatttaaattttttaaaaattaatggggatattctagaggaatttttaacaagaactgttctagatagtgacttggtggagttaatacaatctctgctcaaaacacatggccttgagccaggcactacccttattagtccaagttctattgtagagaccgcaatagaccacgtctcgctattacaagcggtgaaaacaaaaacctctcgaatgcacactattttacaaagcctaggagaaagaatttttaaattgtttaaaaattctggggtacaagactcagacaaaatttctatagacagagtccaactagttgatgaatctgatagcgcaacgatagacttcacagtgattaaagataaacagcgttctcagaaaaaaagtattactgttggcatagaaagtttagctggatcctttagaaaatttagcgcatcgatgcacgaagttattggaactggagtgcttgatttagacttaggaatgactgtcgtctctttagttcagtatgtccgtttagtagaagcaggacaaggaaaagatgctttagcagttgctaatttagtgatgaatcttaaaatagctctcgaggtctctatagggaatgtaattcaggctctgggtaaaaaactgctcactcaggaggggcttaatactttccgtttagaaacagaattagctcgtcaactacacaaagtgggagcacgagttggaggaactgttggtaagacgttaaccagagtagcgcatgtattagaactccccatattagaaagtgcaattggaacatggaacctctataatagtgtgaacgagttattacatgctgattcttggagtgaccaggttgctgctagagtacaagtagcttttgattcaatctctttaggaatcactatagcttcggttgtttctccagcacttatgatggcagcaggccccattgctgccatagggatgggggcagcatccattgctcgtaatgttgccagaaaagaagagcggcactctcaatggctcaagtacaagagttttcttgataatggatcaaaacatacagttgccgcattccctcataaagggcttatagatttatctgagaatttagtacttgggaacattgtgctgaatttaagggtttacccacctctgcttacaggcgatcgctcttataatgcaaatcggtggtttgggaataagcctggatggtctgattggcaagttcgagaaagattaggttatgcctatcgaagcagtccatcttatgcgttagccagaggacacgctaatagtttttggccactatctatgcctagtattgataaaggtgtatatcgcacagtaattctaggatatggcattcaatataaagcggttacagaagttgtctacttgtctaatgaaatggtttggagagaagctgtgatgcagtttgactctcgatactatgtagagccattaacagcggaaaaggagtgtgcaacagtactagcaggagatacgccactatcagtgattcctgtacgtttattagaagaggagtctctggaacgcgagaagaacgcggcttcttataagaactatcagatcattattgagggagggaaaggaggacttactgtacagataggaggagcaggttattacaagttaacagcacagccaggaaaagggaatatcctctctttccgagcaatacctggatatctttctgtaacgtttgatcttagccgattggaacaagaggtgcctctcaccaaacaaaatggaacagccttaaagatacttaaagtacgtcaaactgggtttgatactattgttggatcttcaggaggtagtgataatttaacaggcaatcacaatacaaaattttatctaagcaccggaggaggacatgtcacctcaggatccggtaagaactggtataacattccatctttaacacgtagccttggttttgattttacttctaatgctatagagcataaggcttctgtagagatgcttttagcagatttctctcctgctaataatttaagtttaatagttgaacgatttgcaaatgttagcattcatgtttttaattatagcaataaaacagccccttatactgtgaatttgaaagacggggtgtctttacaagcttctaagcaaggctttagcggtagtttattagaggtggcttcctttgatcaaacgctatggcaaaagagctatccagaagatagaggatttgtagaagatattttatcttggttattaaaactgcaatggtcgttagcttctcgagtaaggatctttttacagggaggcacagcacaatacgaaacaacgcagaaaagtcttatttatagacctgatccacactcaagtatatctattcaggctacagattcttataatacacaagtttatggtaacgttggctgttcttatattctattctcttcaccaggtgtgaccgccaaaacactcgatattttgttattcgaagattcggggttaccacaaattattgacttaagcacacttgttccaacttctatccaagggttcctctatccaggagggtttataaactttcaagtctcttctgcaagatatgcatttcctttttctgtcagttggagaaggcatcattacactttccctgctcaaacgattattcaagttctacctcgcttgcggtttgaactaggggattggtttacaattttgcaaaagagtgtaggaaaatgggtaacattgtaccaacacgacatgattatccctgaacgtattgaaggtgttttaagtctaaataacacagcgacattaatgtcacaccacaatcaaacaacccatatgcttggagtagaaaacaggggagatttgagtctaaaagttttaggaatactccaatctggtcaaattaaaggatctaaatcggaaaatagcgcgagtggtcatttttctaaattgttatctgtcccagcacatacgatcaaaaatctttcgtttaaagaggaagagggaactaagagtaaaaatattttattctacagtgtgctggaggaaacattccttaaagctacagataaacctttaactattattaaacgtgataaatggtctctgtatgatgaaatccaagtatttgcaacaactcttaatctgcaaaatttcttgcgttatcatatttcggaagagactccaatgttatctagactgctcatgtatgcgcagaaacgcgtttccatccaaaatagagatctcgcattgaaatttttctatgttcgagagcgaagtggtattggtgcaattagattggtattcaagaactttttcgaagagagcttgcaggggatattacatggaaccttagagcgagaagttaaacctatgctagctgaaaatccaaatacactaattcattcatcgtatcggaatcatttagaactcatcctaggggaggaaaccttagatctcgcaattatcgttcaagagtttagctcttcaaaaaatattgttgagttgcaaaaagatctagcaacccatcggcttatttatcctcaaggaaaagaagccttgtctcttgcaatctatacccatactttcagtaaagagagcttagtcacatctaaacaacgaagcgaagggttaaaattcatcgatccatcaatgcaggaatatcgtttacctgagacaacgattctcgaaaactcttattatttagacccttccacaggagatttgtatttaacaaagataattgcgcaaccttcacaaagtagagcatttcttatcaaatttaaaaaatacaaacgccactggctagatttccaaaaattagttctttctggatctcatttagaacttatcgcatctactggaacagctttaacatttgtaggccccgaattacggcatttagagattgacttcccaggcgcgttaaatgggactattgccaaagaacacatctcatctcgggcaagtattgtaatcccaacaaacaatcaggtgacacactatgacccaagaatagcgaagcagcattatagctctatcaattatatgctgtgggatctgcgtgatcgtgcgacactatctaagcgagcaaaaactttagatagctatttgttagaagtttgtatgaacttagactcttctaatccaacgtggaatattccaaatgatgtgttgaactacgcggtaggatattatcgaacaatccttcctagctgggtaaaaaataaaatccgtgtaggttccttaattaaagtagaagctgatactgcaaaaactttgagtttctcactaattacgacacaaaatgatctattccaacctgtagtggataaaggattctatatttactacagcgtttcgaaactagccaatcatgttaaactgcgaaatgttactggagatatgttgcttgatatcgataaggaaaccacatttattgttcgaggagtagatgaatctgattatgataagaaacaaatctatgttgttttagatctgacaacagaagaagaacgtaaattgcgaacggataagaacatcattattattcctggaggagaacgattgaaccgatga

SEQ ID NO: 73 - DNA, 363 bp, Chlamydia muridarum
atgtttatttcttttgataaaactttatctagacattctacggatttggcagaagcttttggaaacaagcttctctatcctgtgacccaaggatttggaacccgtatttcagtaaagcctgttttagtaatcgatgatatgacgatccatggcttctcagtgaaacaagagtctctttgtaagcgaatctgttgtgttatagcgtgtatcttattggcgcccattgtccttctaatgacccttatcggagtcatagcatataactgttcagctacttataaaagagtacaagatctttatcttgcaactggtttagaatttggaaaagaatggggtccgtggacgtgcgcgccacaaatataa

SEQ ID NO: 74 - DNA, 1584 bp, Chlamydia muridarum
atgcctaaaaaaaagtttttatatatcttgatccccttcttgagccttacttttggcttaacgtcttgtcaccagaaagaagaaaacctaagaaatattttgcgtgttgctatttgccacgatccaatgtctttagatcctcgccaagtttttttgattaaagatgtttgtatagcaaaagcactttatgaaggattggttcgagaaaatgatggcagtcttcatttggctctagcagaaagatacagcttgtcccaggatcggtgtgtctacactttttttctaaaaaaaactttttggcataacggagatcttgtaacagcatatgattttgaagagtctataaagcaattttatctccatgaggttgataatgttgcgttacgattgcttgcgttaattaaaaattctcatgctgttctaaaaggagacattcctgttgaaaatttaggtgttcgcgctttagatgaacatactcttgaaatcactctagaacacccctcttctcattttttagaaactctcacacatcccgttttttatccagtgcatgcttctttgagagaatattatagaaatcgaagtaaacgctctcttccaataatttctaacgggccttttatcattcggtgttatgagccacaaaattttttgttgcttgataaaaatcctttttatcatgaccaaaaaaatgtttctttagatgctgtacgcttacaaatagttcccgatattcatacagcggtgcaattgtttcaaaaaaaatatgtggatttagtggggttgccttggagctcctccttccctctagaagaacaaaaaaatctttctcaagattttttgtatgattatccggtgctaaattgcacagttctattctgcaatgttaaccacaaaccattagataatccttcgctaagagcggcactctctttagccattgatcgagaaacattattaaaattagctggcaaaggaagcattgctaccagttttgtacatcctagtctatctaagatgcctttagatgttctttcgcaaaaagagagaatctctttagctaaaaattacctagcggaagctttaaaaactgttcctcaagaagagttaaaaaaaatcacactcatctaccccatagaatctattgtcttgcgagcagttgttcaagagattcgtcaacagttatttgatgttttaggatttaagatttctactttaggattagaataccacagttttttggataaacgttctaaaggagagttttctttatcaacaggaaattgggttgctgattatcaacaagccaaagcttttctatccatccttggtaatgggactaaatataaagattatcaagtgattgattggcaaaatcaagaatatacggatatcgtatctcgacttttggttgaggattcaacagatttacaaattctagcagaacaactattgctcaaagaatcccctcttattcccctttatcacttggattatgcttacgctaaacatcctaaagtctctaatctccaaacctcctcactcggagaaattgatttaaaaagagtctcgttagtggagtaa

SEQ ID NO: 75 - DNA, 714 bp, Chlamydia muridarum
atgaatcagaggattcctttgaggaaaaagatccttattattgttacagcattgggatttgtttcatgcgtgggcttgatggtgcaaacaaaacgctctattatgccgccaaaagcacatatacccaccacagcaaaatattttcctacaatagggaatccttatgcacccattaatattactgtgtttgaagagccttcttgttctgcgtgtgaggagttttcttcagaagtctttcctttgatcaaaaaacgctttattgataccggggaagcctctttcactttgattccggtctgttttattagaggatcaatgcccgctgcacaggctttgctttgtgtctatcatcatgatcctaaacgacctgatccagaagcctatatggagtattttcacagaatccttactcataaaaaaacagaaggatcacactgggctactactgaagttcttacgaaattagcagaaaatattcctacgcattctggtagagaaattaatcctacagggttgatgcaatgtgtaaattcgcagaaatttgcggaacagctaaaaaagaacaatatttatggatctcaagtcatgggtggtcaacttgctactcccacagcaatagtgggggactatcttattgaggatccaacgtttgatgaaattgaaagagtaattactcaactgcgtcatttacaagcaatggaagaggaggaatag

SEQ ID NO: 76 - DNA, 729 bp, Chlamydia muridarum
ttggtttttattgttattatgctttctaagttctacaaactttctttatctgctgttttattgatcaacatgttctctcctgtagaggttttttctgccgaggggacaacaggttttattggtcgaatgaaatcgtggatctcaggagaaaagactagtctcccaactacagaggatttgcagacttctgctattacaaaagtctcagaccttttgtcttggaagcgctacgattatacgcaggaaggcggcttttctgttcagttcccggagttcccggagcattcagggcagattgtggagattcctcaatcagacttagctatccgttatgacacgtatgtggcagaaactcctaatgatagcacggtttatgtagtatctgtttgggaatacccagaaaaggtggatataagcaagccggagttgaatctacaagaaggtttttcaggaatgctatatgcacttcctgaatcacaagtgttatatcttaaagcaacagaagtacaagggcataaggctctagaattttgggttgcctgtgaagatgtatatttccgagggatgcttgtttctgtaaaccacaccttatatcaagtatttatggtttacaaagggcgttctccagaagttttggataaggagtacaatatctttattcaatctttcaaagtcacaaaggttagaaattccaaaaaaatggatataaggaaaagggtgtccttataa

SEQ ID NO: 77 - DNA, 717 bp, Chlamydia muridarum
atggtcaatagtgttaatgctttttaccaaaaagaggtgaatgcctcgccaattagcagagaagaatgtgtagggaaaagcaacagcaaggtcttttctaagggtgcttgttgcgcaaaaattattggagttgctttggccgttttaggtctagctcttgctattggtggagcggttttacttggtgttggatctctatcttgtctgcttcctgtatttgtccccatagcgatgattgctgttggggttgttcttttaggattagggagtgttaatgcctgcttgagttccccacgaacagttaaagtagcggataagctggggaatcagcaaattcgcattttaaggaatcgtgtttgtcaattagaaaatcaagtagtggcttcccgcgctcggttatcagccttagaagatgaacttacagagcagcagtacattacgaacgcttttcagactgccttggaagcgggggaggatggagttccttgtggcaagatgaccgctaagatgaaaatggatgctgctaactctgagattttatgtcgtgtgagagaaataaccctgatgggacaagctttaaaccaagcattggatagaatccaactcctccgtaatcagctacggactagttctcgatacattgttggatcggaagaggagtgtacgccgttgttagacgcagaagaaacttgttgttctctggattcaatttgctaa

SEQ ID NO: 78 - DNA, 645 bp, Chlamydia muridarum
atgagttgttctatcggtagtacacaaacacttaacacccatttccaagggatagccgatagtctggctaattgtacaggtaaaattcgggaaacatgctcttcaagagtaagtgcgagggttatgggagcggccttggctgtcatcgggcttttggttgctgctgctgggattgtggttgctgctgctggacttgggtgtgcagttcctctggctatagggttaattttagtaataatagggtctgttcttttgggactgggccttgctaagacgcgaagccgtcgttcagagttggagcagcagcttgcagctgtttttagtcgaattgagtatcttaaagaggagcataaaaatttgaatgaggtttatgctttgaactgtgaagctcgtaaaagtgtaagtcaacactgccagtcattagagaagcaaatatgggatttatgcaagaaacatgctgataccataagcgttcttgaagaagatgctcggcaagataaagagcgatgcgtaagttgttttcagaagcaattgaaacagagtcaagatacttgcgagcgattaactagagcattatgtaatgctaaaaatcagtgtgctgaattagagaaagaattggcttgtgttaaagctaagaagaagtaa

SEQ ID NO: 79 - DNA, 2379 bp, Chlamydia muridarum
atgcttggaatacgaaaaaaaacgattctgcaactcgctattttactgttgctccccttttcacaaaacgcctttggaacatctcctgaaggacgtatggtggtacaatccatcactattgagactcgaggagaaaatgctcaaaataagcgggctattcccaaaataaagacaaagcaagggacgctgttctctcaaactgattttgacgaagatctaagaactctctcgaaagatttcgaccgcattgatcctattgtagagtttcgcaatgggcaagctgttatttcccttattctgacagcaaaacccgttatccgacacattaacatctcagggaatgaagcaattcctactcataaaattttaaaaaccctagagctttataaaaacgatctttttgatcgagaggtttttttcaaaaattttgatgctttaagaaccctttacttaaaacgcggatactacgattctcaattgtcctattctcacgatcataatgagcaagaaggttatattgatatctcaatccaaattaaagaagggccctacggacggataaaaaaattaacaatttcaggtattactcgtacagaagcctctgatttgggagacatagttttaaccaaacagtactctacaacaacaagttggttcactggagcaggggtataccatccagacatggtggaccaggatctctttgccataacaaactattttcaaaataaaggttatgcagacgcaaaagtcacaaaagaagtctccacagatgctaaaggaaacctctctcttgttatcaacgtagataaagggcccctgtatactttaggtcacgtacatatagaaggtttcacagctttatccaagcggttacttgataaacaactgttagtgggccccaattccttatattgcccagaaaaagtttgggctggagctcaaaaaatccgtaatgcctacgctagatacggatatgtaaataccaatgtagacgtatcttttgctgttcatccaacgctcccagtttatgatgttacttacagggttagcgaaggagctccttacaaaatcggactaatcaaaatcaaagggaacacacacaccaaacatgacgtaattttacatgagacaagtctgttccctggagatacttttgatagattaaaactagaagatacggaaactcgattacgtaacacaggctactttaaaagtgtgagtgtctacacggtacgctcacaattagatcctttggactcaaataacctttatagagacgttttcattgaagtcaaagaaaccgaaacaggtaacctaggactgttcttaggattcagttctatagaccatctgttcggaggagcagaaatttcagaaagcaattttgatttatttggcgcccgacacttattcaaaaaagggtttaaatccttaagaggtggtggggaatatcttttcttaaaagccaatttaggagacaaagttactgattatactgttaaatggacaaaacctcatttcttaaacaccccatggatcctaggagtagaattagataaatctattaataaggctttatcaaaagattattccgttgatacctatggaggaaacatcagcacgacatacattcttaacgacaaactgaaatatgggatgtattaccgcgggagccaaacgagcctaagtttaagaaaaaaaacagaaaatcctaacaaacctggaccagatctagatagtaacaagggatttgtttccgcggcagggcttaacgttctttacgattctattgacaatcctagaaaacctactatgggtattcggagctctttgaactttgagttgtctggattaggaggaacctatcagtttacaaaattaacagccagcggctctatctatcgcctgctaactaaaaaaggtgttttgaaaattcgtggagaagctaagtttattaaacctttcggtacaaccacagcccaaggaattcctgttagtgagcgcttcttcttaggaggagaatctaccgttcgtggatataaaccatttattattgggcctaaattttctccaacagagcctcaagggggcttatcttccttattgctaacagaagagtttcaatatcctctaatttctcaacccagcatcaatgcattcgtttttctagattcgggctttattggcacggaagagtacactattcgactcaaaaatctctgtagcagtgccggatttgggttgcgttttgatatgatgaataacgtgcccattatgttaggttggggttggcctttccgcccaacagaaattcttaataatgaaaaaattgatgtatctcaaagattcttcttcgctttgggaggagtgttctag

SEQ ID NO: 80 - DNA, 522 bp, Chlamydia muridarum
atgaaaaagttcttattgcttagcttaatgtccttggcttcttcaaccgtgtttgcagcaagttctacaaatacaattggaattgttaacctacgtcgctgcctagaagaatctgaactaggcaaaaaagaatctgcagaatttgaaaaaatgaaaaatcagttctctaacagcatagggaaaatggaagaggaactgtcttctatttattctaaactgcaggacgacgattacatggaagggctatccgaatctgcggcagctgaattaagaaaaaaattcgaggagctatcttcagaatacaacacagctcaggggcagtattaccaaatactaaatcagaacaacctcaaacgcatgcaaaaaattatggaagctgtgaaaaaagcctctgaggttgttcgaatccaagaaggcctttcagcgcttcttaatgaagatattgtcttagctattgatacctcttcagacaaaacggatgctgttattaaaattcttgatgattcttttcaaaataattaa

SEQ ID NO: 81 - DNA, 2364 bp, Chlamydia muridarum
atgagaatgaataaacgaacgttattatttgtttccttagtgagcgcagcatttttgggctgccagattttctttgggtatcaggatttgaaatcttgtcaggatctggcggaaaaacagcgtgctatttctgagcaaatattagcttcaacagagcagttgagtgtagttccttggacggcttctgcagaagaaagcgaatcggttaatcaatatgctgttcgtttagggaatcgacttctcgttttaacaaaaggaggagctcattctgaggtacattctaaaggaacctcctggaagctaatagatcaaactagtaccttcggggggattctggtttctttgtatggagaggatgggcaggaggttttatcaaaaggcggttccgtatatctccctaatcaacaagatgcactccctgttttagtggccgagtttcgcagaaaccaagaacctcttgtgtttttcggagagtataaaaatggcaagctttctaacaaagcagggactatctatgggacttcgttagtttttcttaatacagggaatgaatttgttcctttaggcatttacaattctaaagaagagtgtgtggaatctctggatcttcctatggcaagagctgtagtttttgccgataaagagaacctgacaacgtcaggcagttattacatgctcgctaatgaatatatgcaagttatagtctctcaggaaagtggagctattgaggggattaatcttccttttgcttctgatcgagaagggaataagagcattgtcaatgaaattggatttgatagagaattagcagccggctctccatctgaggcttctttccctggagttcaagctattgattctcagcgtcaaaatgtatcgagtgttgtaggtggatactatcctttgcttagacgagggactctatctgataccagaaaaatggtttcccctcagtatcaagccttaaacatagtctctgggagagagttgtcttctcctgtcgcaacgggttttcgtgtagtttcgtttgataataaaacgttagttttggaaagcggggatgggggcattcggaaaacgtatacccttggagaacaaccttacgcttttgaccttgaaattcaaactactagaggacaagaagacttatggataacttcaggagtgcctgaagttgagatcatgtctaatgcttttgtccctgcagttaagtatcatgcagtgaaaaaaaataagagtgacctcattaatgtgaagttacccaaagcaaaagactctttgttagtacgtaatgacgcttcccctcaatggattttaaattccaatggatactttggagtcattcttactccgaagacccctcttcctacgggatatgcttcttctttcattcctgggaatgcagttcctacgcgacttactcaactttccccaaaagatcaggcttacccagcttcgaaatatcctggttatactgcaatgcttcctttgcctaaagaagctggccgttatcagtttatggtgtatgcgggtcctttatcagagcctactttgaaggctttagatcgagctcacacgaatcataagggagagtctcctgagtatgttgatgcgattgcatttagaggtttctttagttttataacagaaccttttgcagctttgttatttattataatgaaatttttccaatttctaactggatcttggggaatttcgattattttattaacgattgtacttaagcttgtgctttatcccttgaatgcttggtctattcgatctatgcgtcgtatgcaaaagttatctccatatattcaagatattcagcagaaatacaagcgagagcctaagcgagcacaaatggaaattatggccttgtataaggtcaataaagttaatccaataacaggctgtcttcctctaattattcagatcccatttcttatagcaatgttcgatcttctgaaatcttcgtttttattgagaggagcgagctttattcctggatggattgataatttaactgctccagatgttcttttttcttgggaaaccccaatatggttcattggaaaggaattccatctccttcctattttgttgggtattgttatgttcgctcaacaaaagatttctgctattaaaagatctgggcctgtttcggatcaacagcgtcagcaagaggctatggggactatgatggcgctattatttactttcatgttttataatttcccttcagggttaaatatttactggctttcttccatgttactcggcgttattcaacagtgggcaacaaataaaattttggatgaaaaacatttacagcatgaagtgattgttaataagaagagatag

SEQ ID NO: 82 - DNA, 480 bp, Chlamydia muridarum
atgacgacatggactttaaatcaaaataatctcacaaaatttctaaaccatgctcagttagagccctctttggaacgagaaagcggcctaacttacattacgatctccgctggagaacatgaacttcctctgtttttcgttattcgtaacgagggagaagtcttacaacttgtctgctacttcccttatcaaatacaagaaggccaacgagatgccacagcaagacttttacaccttgttaatagagacattgacattccaggatttggaatggacgaagaacaaaacattattttctatcgactagtcatcccttgtttaaaaggggagattaatgaaaacttgctacgagtttatatagatacgattaaattaatttgtgacagctttttccatgccatagggttgatctcgacagggaatatggatctcgatgaattaaaaaaacaagcgaaccaggaaaataatcaaactaattaa

SEQ ID NO: 83 - DNA, 807 bp, Chlamydia muridarum
ttgcagggaagggacatgaggtatatcagatcttcaaacatcagacgattgtctttgatgatcgagaggttgtgtgtgaagctttggcctcgatttattaattcaaaattcttgtttttactgcttgctttgggtgtcggtccggataagtgtttttcggatgctgtaaatactcctgttgttcccaaggtaagtcgaaatgagcttattgtgatagatcctggccatggtggtaaggatgaaggaactgcggataaggagctgcgatataaagagaagtctttagctttatcaatagctttaagtgtgcaggggtatctacgccgaatgggatataagacgatcatgacaagatccacagatgtttatgtggatttgaataagcgagcggcgatagcaaaccaaaacaaagcagatgtttttgttagtatccattgtaattactcctctaatacctctgctttaggtacagaggtctatttttataatgataaaaatgtattgagaactaaaaaatcagagaaccttgggaaatcgattctagctttcatgcaaaagaatggggctttgcgggagcgtaaggttaaagagggtaattttgcagttatccgagaaacctccatgcctgcggtcctggtagaaacagggttcctctctaatccaaaagagcgagcagctcttttagactcccgttatcgttcgcatttagctaaaggtatttctgaaggaatacatgcctttattcttaatcgacagattaaaaagactacagcggggaattcgggagtaaaaaaagtgtataaataa

SEQ ID NO: 84 - DNA, 957 bp, Chlamydia muridarum
atggcatccaagtctcgtcattatcttaaccagccttggtacattatcttattcatctttgttcttagtctggttgctggtacccttctttcttcagtttcctatgttctatctccaatccaaaaacaagctgcagaatttgatcgtaatcagcaaatgttgatggccgcacaaattatttcctatgacaataaattccaaatatatgctgaaggggattggcaacctgctgtctataatacaaaaaaacagatactagaaaaaagctcttccactccaccacaagtgactgtggcgactctatgctcttattttcaaaattttgttagagttttgcttacagactcccaagggaatctttcttcttttgaagatcacaatcttaacctagaagagttcttatcccaccccacatcttcagtacaagatcactctctgcatgtaatttatgctattctagcaaacgatgaatcctctaaaaagttatcatcctcccaagtagcaaaaaatccggtatccatagagtctattattcttcctataaaaggatttggtttatggggaccaatctatggatttcttgctttagaaaaggacggtaatacggttctagggacatgctggtatcaacatggtgagactccaggattaggagcaaatataactaatccccaatggcaacaaaatttcagaggaaaaaaagtatttctcgcttcctcttccggagaaaccgattttgctaaaacaactctaggactagaagttataaaaggatctgtttctgcattattaggggactctcccaaagctaattccgctgttgatggaatttcaggagctacactgacctgtaatggagttactgaagcttttgctaattcgctagctccttaccgccccttattgactttcttcgccaatcttaactctagtggagaatctcatgacaaccaataa

SEQ ID NO: 85 - DNA, 2073 bp, Chlamydia muridarum
ttgttagcgttttttaacaaacatcaaaagaaatttatcggattagttatcgctggcgtttgtttatctggagttggcgtaggtattggtcagacctttaaaaaaacgcaaaaattcgggtctaacaaaaccgtttataaaactccatcgggtagaaaatactctgaaaaagaattttttcttttaaaacggtttttatctaacgaagcttatccttttactggtaatcccaaagaatggaattttcttaatgaaggggtattaacggagcgtttcttaacgaataaattaggagagaaattatttcttagtgtgtacaagtcagggttccctgctttcgataaggaacggagctatgaggggtatcggcgttttgatgctccttttatttcttctgaagaagtttggaaatcctccgctcctcaattacgagatgcttttcatatattccaacaattagaaaacccagtttctccggaagggtttgctgctagagtaaggttattcttagaagaaaaaaaattccctcattatgtccttagacaaatgttagaatatcgtcgccagatgtttaatcttccggtagacggctctttggcgcaaggccgggacttgcgtttgtttggatatcgtaatattaaagattggtttggagataggtatgtttctgcagtaacagaagcggtgttacgtttcatagatgagcagaaaaagaacatcgcaatgccatctttgaaagaagctcagcaggatttctatgataaagcacaacaggctttcttgagactcagtaggcatgcggagtttaatctgacattagatcagctagtttcttctttttactcttttatgggagttgaagaagcagagtttatccgtatgtatcgagaaattttgttatataaaagagctcttttagcattggaaggtgctgttgcctttgacttctatcctttacagaaattcttttctatggggaaagatacggtctctgtagaaatgtttcatttaccagaaactttagtctttaaggataaagaagatttagaggcttttgagacatatctcagtttagtagccgcgccttcgagtcatatcttagacgttcaaacgaaattgcttcctatcgaaaaggtaaaaagcaaagctgagtgtttggtagggaagagattttctgtttgttatcgacgtgtgaaactctcggaacttgaaaaatatatccctatggctcaggtataccagtggtatcagaatcccgagaatttcgaagaaattttattagagtttcctgaactagagacgtgttcttctcttcgtgatgtcttgaatttgaaaccagcaatcgtagagagagcgcattcttatgtaaggaaggcgattcttcgagctgatttaggaatcattcagtctgagttagctaagcaagagcaaaaagaagaggagcttttcttatctttagggccagatcatctattgcctggcattcaaaatggagttcgtctggctaacgttttgatgcagcaagattccgttgattactatacacaggacgatgaatatttttattctatcattgtaaaaaatcgtactggtacggatgaggtattgccttataaggaagtagttcgtaaggggctgaagaaagttttgctagaacgttataaagcagaagagcgcattactagggtcttggctcatttacaagaggctttccctaattgtcagggcaaggatctctatcaaagacgtttaattagatttgttaagtcgcttcaatctggaagattttctcaaggagatctgttctggggattggagaaaactgtgaagacgttttctagaggagatcaaggagtccctcaagagtttgaagaaatgctggccttgaaagaagggcaagtatcggatgtattatttgattcggataaaggtcctttctattatacctttatctcaaaaacttattgcgattatccggtaagtttagacaaattgctgtttgcaaaaaatcatttgaatgaagagcttttaagaccttatttatcagagatttttttccaaaacgagagttag

SEQ ID NO: 86 - DNA, 384 bp, Chlamydia muridarum
ttgggaaacgctttcaataatccctttatttttagagacattaatatgaacaacattacattatctgcaagctcttcttctttaaattctgaaccagatcgtcctcaagaaaaagtcaacccccatttgctttttattttggccttaattcctgttatagggctaggtgttgcgctttatttatgtattaaaacaacagatgttcactggaaaagcaatgctggggttgctgtcctcggaggattaggaattttagccatcgcctacatcttaatacagactctattggtaattcgtctggcttttaagaaaattaataattttcttcaccatcctactttgccttgctgtatttccttttcgtgtaaaacaaaaacagagtag

SEQ ID NO: 87 - DNA, 1776 bp, Chlamydia muridarum
atggtagcaacttcaaaacaaacgacgcagggctatgtcgtagaagcttacggaaatttattgcgggtgcattttgatgggcatgtgcgtcaaggagaagtggcctatgtcagcgtggatgatacttggttgaaagcggaaattatagaagttgtgggagatgaggttaaagtccaagtttttgaggaaactcaaggaatttctcgaggcgctttggtaactttttccgggcatttattagaagcggaacttgggcccggtctattgcaaggtatttttgacggacttcagaatcgcttagaggtattggcagatacaagcttgttcttgaaaagaggggagtatgttaatgccatttgtcgggaaactgtatgggcttatacgcaaaaggcttctgtcggggatgttctatctcggggagatgtgcttggtacagtaaaggaagggcggtttgatcataaaatcatggttcctttctcttgttttgaggaagtgactatcacttgggtcatttcttcaggagattacactgttgataccgttattgctaaaggacgtactgcttcaggagccgagcttgaatttacaatggttcagaaatggcccattaaacaggcttttttagaaggggaaaaggtaccgtctcatgaaattatggatgttgggttacgagtattagatactcagatccccgtcttaaagggaggaactttttgtactccagggccttttggtgcaggaaagaccgttttacagcaccatttatctaagtatgcagctgtagatatcgtagttttgtgtgcttgtggagagcgagctggagaggttgtagaaattcttcaggagttcccgcatttgacagatcctcatacggggcagtctttgatgcataggacctgtattatttgtaatacatcttccatgcctgtagcagctagagagtcctccatttatttgggtattactatagcagaatattaccgtcaaatggggttgcatgttttgttattggctgactcgacatctagatgggctcaagctttaagggaaatttcagggcgattagaagaaatccctggagaagaagctttcccagcctatttggcgtctcgaatagcagctttttatgagcgaggcggggctgtgaaaatgaaagatggatcggaaggctccttgactatctgtggagcggtttctcccgcaggaggaaattttgaagagcctgttacacaagcaactttatctgttgttggggctttctgtgggctttctaaggctagagcagatgctagacggtatccttctattgatccgatgatttcatggtctaagtacttggattctgtggcggagattttagagaaaaaagttccaggatggggagattccgttaaaaaagcttctcgtttcttagaagaaggagcagaaattggtaagcgaatagaagttgttggggaagaagggatttctatggaagatatagaaatctttttgaaatcagagttgtatgatttctgttacttacagcaaaacgctttcgatgcagaggactgttattgtccttttgatcgtcaaatagagcttttttctttaatgagtcatatttttagctctagattctgttttgattgtccagataatgctcggagtttctttttagagcttcaaagtaaaattaaaacgctgaatggtcaaaaattcctttctgaagactatcagaaggggctagaagtgatctataaactattagaaagcaaaatggtgcagacggcgtag

SEQ ID NO: 88 - DNA, 4191 bp, Chlamydia muridarum
atgttcaaagaaggttctcgagacgatgcagccctagcaaaagaagggttgtttgataagttagaaattgggattgcttcagatgtgactattcgcgacaagtggtcttgtggcgaaattaagaaacctgagacgatcaattatcgcacattcaagcctgaaaaaggcggattgttttgtgagaagattttcggtcctactaaggactgggaatgttactgcggtaaatacaagaagattaagcacaaaggtattgtgtgtgatcgttgcggagtggaagtcacgctgtctaaggtgcgacgagaaagaatggctcatattgaattagctgttcctattgttcacatttggtttttcaaaactactccatctagaattggtaatgttttgggaatgacagcttcggatttggagcgtgtaatttactacgaagaatacgttgtcattgatccaggtaatactgatcttgtgaaaaaacaacttctgaatgatgcaaaatatcgagaagttgttgagaaatggggtaaagatgcttttgtcgccaaaatggggggagaagctgtttatgatcttcttaaatccgaggatttagaaagcctccttggtgagcttaaagatcgtttgagaaaaacaaaatcccagcaagcaagaatgaagcttgctaagcggttgaagattgtagaagggtttgtatcttcctctaaccgtccagaatggatggtcttgaagaacatccctgttgttccaccagatcttcgtcctttagttccattggatggagggcgttttgctacttcagatctgaacgatttatatcgtagggttattaatcgaaataatcgtttgaaagctatcttgcgcttgaagactcctgaggtaattgttcgcaatgagaaacggatgttacaggaagctgtggatgctctgtttgataatggacgtcatggacatcctgttatgggagcaggaaatagaccccttaagtctctatcagagatgttaaaagggaaaaatggtcgtttccgacaaaacttattaggtaaacgagtagactactctggccgttctgttattattgttggtcccgagttgaagtttaatcaatgtggtttgcccaaagaaatggcgttagagttgttcgagccattcattatcaagcgactaaaagatcagggtagtgtttatactatccgttcagcaaagaaaatgattcaacgaggcgcaccagaggtttgggacgttcttgaggaaatcattaaaggacacccagtcttattgaaccgagctcctactttgcaccgattgggaatacaggcttttgagccagtgttgattgaagggaaagcgattcgggttcacccattagtgtgtgcagcgtttaacgccgatttcgatggagaccaaatggcggttcacgtgcctctttctattgaagctcagttagaggcgaaggtgttaatgatggctcctgataacattttcttgccatcttctggaaaacctgttgccacaccttctaaggatatgacattgggcatctattatttgatggctgatccaacgtattttcctgaagaacacggagggaaaactaaagtatttaaagatgaagtagaagtacttcgtgctttgaatgctggaggttttatccttaaggatgagatatgtggttctcgtcgggatgaaactggacgagggattcatattcatgaagccattaaagttcgaattgatggtcaaattattgagaccactcctggccgcgtatttttcaacacaatcgttcctaaagaacttggcttccaaaactatagtatgccaagtaaacgtatcagtgagctaatcttgcaatgctataagaaagttggtttagaagctactgtacgctttttggatgatttgaaagagctaggtttcgtgcaatctacgaaagctgcaatttctatgggattgaaggatgttcgaattcctgaaattaagaaagagattttgaaagacgcttacgataaggttgctgtcgttaagaaacaatatgaagacggtattattaccgatggggagcggcattccaagacaattagtatctggactgaagtttccgatcttttatctaatgcgttgtatgctgagatcaaaaagcaaaccaatagcaaacataatccgctgttcttaatgattgattctggagctagaggaaacaaatctcagttgaaacagcttggagctttgcggggattgatggctaaacctaacggagccattattgaatctccaattacttctaacttccgagaaggattgacagtgcttgagtactctatttcttctcacggagctagaaaaggattagcagacacagcgcttaaaactgcggattccggatatttaacccgtcgtttggtggacgttgctcaggatgttatcattacagaaaaagattgtggtacattgaatcatattgaggtgtcgacaatccgtcaggggtctgaagaattactgcctttgaaagaccgtatttatggacgtacagtttctgaaaatgtctatcagccaggagataaaagtaacgttttagcctatgctggggatgtattaacttcttcccaagctgaggctattgatgatgcaggtattgatagcgtaaaaatccgatctacgcttacttgtgaaagccggcgaggagtttgtgccaagtgttatggtttgaaccttgctaatggccggctgattggattaggagaagctgttggtattattgctgctcaatccattggggaacctggaactcagttaacaatgagaacgttccaccttggggggattgctgcgacatcctcaactccagaaatcgttgccgagtgtgatggaattcttgtttacttagacttacgctttgttgtagaccaagaaggtaataatcttgttctgaataagatgggagctcttcacttggtccgtgacgaaggacgaagtttgagtgaatacaagaagcttttgagtacgaagtccatcgaaagcttagcgacattcccagtagaattgggagctaagattttggttgatgacggtgcagctgtcacggccggacaaagaattgctgaagttgagctccacaatatcccaattatctgtgataagccaggattcgttcactatgaagatttagtggaaggagtttccacagagaaagtcacgaataagaacacgggtcttgtcgaattaattgtgaaacaacacaggggagaattgcatcctcagattgctatatatgctgacgccaatatgcaggaattggttggtacatatgccattccttctggggctattatctctgttgaagaggggcaacgtattgctccaggaatgttgttagcgagattgcctcgaggagcaattaaaacgaaggatattactggtggtttgcctagggttgcagagttagtagaagctcgtaagcctgaagatgccgcggatattgctaagattgatggggttgtagacttcaaaggtatccagaagaataagcgtattcttgttgtgcgtgatgaagttacgggaatggaagaagagcatctgatttctttgaccaaacacttgatcgtgcaacgtggagatagcgtaatcaaaggtcagcagttaacggacggtttagtcgttcctcatgaaattcttgaaatttgtggggttcgtgaattgcagaaatatttggttaatgaggttcaagaagtataccgactgcaaggtgtggacattaatgacaaacacattgaaattattgttcgacagatgttgcagaaagtgcgtattactgatccaggtgatacaaccttgttgttcggagaggatgtcgataagaaagagttttatgaagaaaaccgccgtacggaagaggatggagggaaacctgctcaagctgttccagtgctgcttggaatcactaaagcttctttgggaacggagtcctttatttccgcggcctcattccaggacacaactcgagttttaacagatgctgcttgcagtagtaagacagattatctgctaggattcaaagagaatgtgattatggggcacatgatccctggtggtacaggatttgatacgcataaacgtattaagcagcacctcgaaaaagagcaagaagacttggtctttgacttcgatagtgagtttgagtctgtagcaggctaa

SEQ ID NO: 89 - DNA, 3759 bp, Chlamydia muridarum
atgttcaagtgcccggagcgggtcagcatcaaaaagaaagaagatattttagatcttcctaatcttgtcgaagttcaaatcaagtcgtataagcagtttcttcaaattgggaagctagctgaagagcgagaaaacattggtttagaagaagtcttcagagaaattttccctatcaaatcatacaatgaagctacgattttagagtacctctcttataacttaggagtgcccaaatactccccagaagagtgtattcgtcggggaattacttatagcgttaccttaaaggttcgtttccgtttgactgatgaaacgggaattaaggaagaagaagtctatatgggaactattcctattatgactgacaagggaacctttattatcaatggagcagaaagggtcgttgtttctcaagttcaccgttctccagggattaactttgagcaggagaaacattctaaagggaatgttttgttctcttttagaattattccttatcgaggaagttggttagaggcttcttttgatattaatgacctcatctatattcacattgataggaaaaaacgtcgtagaaagattttagctatgacgtttattcgagcattggggtattcgacagatgctgatattatcgaagaatttttcgctgtagaagagcactctctgcgttcagaaaaagattttgttgctttagttggtaaagttttagcagacaatgtagtagatgcggattcttcgttagtttacgggaaggctggagagaaactcagtactgctatgctgaagcgcattttggatgctggggtacaatctttaaaaattgccgttggagctgatgaaaatcatccaattatcaagatgttggcaaaagatcctacagattcttacgaagctgctcttaaagatttttaccgcagattgcgtccaggtgagccagcaactttagctaatgctcgttctacgattatgcgtctatttttcgattctaaacgttataatttaggtcgtgttggacgttataaattaaataaaaaattagggttccctctagatgacgaaacactgtctcaagtgactttgagaaaagaagatgttattggagctctaaagtatctaattcgtttgcgaatgggtgatgagaagacgtctatcgatgatatcgaccatttggcaaaccgacgtgtccgttctgttggagaattaattcagaatcattgccgatcaggattggctagaatggaaaaaatcgttcgagaaagaatgaatctcttcgatttttcttccgatacgttaactcctggaaaaattatttctgccaaagggctagttagtgtcttgaaagatttctttagccgttcccagttgtcccaatttatggatcaaacgaatcctgttgcggaattgacacataagcgtcgattatctgcattaggacctggaggattgaatagggaaagagccggttttgaagttcgagacgttcattccagccactatggtagaatttgtccaattgaaactccagaaggaccaaacattggattgatcacttccttgtcctcttttgctaagatcaatgaatttggctttattgagactccttatcgcgttgtgcgtgatggcatcgtaacagatgaaattgagtacatgactgctgatgttgaagaggattgtgtcatcgctcaggcatctgcggagcttgatgaatataacatgtttaaggattctgtatgttgggctcggtataaaggagaagcttttgaagcggatacgagtacggtcacacatatggacgtctctcctaaacaattggtgtctgtagttaccgggcttattcctttcttagagcatgacgatgctaaccgagctcttatgggatcgaacatgcaacggcaggctgtgcctttattgaaaacggaggctgctattgtcggaactggattagaaggacgtgcagctaaggattctggagctattgttgttgctcaagaagatggggttgttgaatatgtcgacagttacgagattgttgtagcgaagaaaaataacccaacgctgaaagatacatatccacttaaaaagttcttaagatctaactctggaacatgcatcaaccagactccgttatgttctgtcggagatgtagtgacacatggggatgttttggctgatggacctgcaacggataaaggagaacttgcacttggtaaaaacgtgctagtagcctttatgccttggtatgggtacaacttcgaagatgcgattatcatctctgaaaaattaatcaaacaggatgcctatacttctatctacatagaagagtttgaactgacagcccgagatactaaacttggtaaagaagaaatcacaagagacattccgaatgtttctgaggaagttttagcaaatttaggagaagacggaattgtccgtattggtgctgaagttaagcctggggatattcttgttggtaaaatcactccaaaatctgaaactgagttagctcctgaagaacgcttattgcgagctatttttggtgaaaaagctgctgatgttaaagatgcttctttaacggttcctcctggtacagaaggggtcgtgatggatgttaaagtcttcagtagaaaagatcgcttgtctaagagtgatgatgaactggttgaagaggctgtgcatcttaaagacttgcaaaaagagtataagagccagcttgctcagttgaagatggaacatagagagaagttgggagctttattgcttaatgagaaagctcctgcggcaatcattcatcgacgctctgcagatattttagtgcaggaaggggctgtttttgatcaagaaactatagagcttttagaaagagagtctttagttgatctcctaatggctccttgtgatatgtacgatgttttgaaagacattctttctaactatgaaacagctgttcagcgtttggaagtaaattacaagacagaggctgaacacataaaagagggtgatgccgatttagaccacggggtaatccgacaagttaaggtctatgtagcctccaaacgaaaattacaagttggggataaaatggctggacgtcacggaaacaaaggggttgtttccaagattgttcctgaagcggatatgcccttcttggcgaatggagagacggtacagatgatcttgaacccattaggggtgccttctcgaatgaaccttggacaggttttggaaacgcatctgggatatgctgcaaaaacagcaggtatctatgttaagactcctgtctttgaagggttccctgaatcgcgtatttgggacatgatgatcgagcaaggcttacctgaagatggtaaatcctacttattcgatggtaagactggagagcgtttcgacagtaaagtggttgttggatacatctatatgttgaaattgagccacctgattgcagataagatccatgctcgttcgataggaccttactctctcgttacccaacagcctctcggaggaaaagctcagatgggaggacaaagattcggggagatggaagtttgggccttggaggcatatggagtagctcatatgttacaagagatcctaaccgtgaaatctgacgatgtttcgggaagaactcgtatctatgagtcaatcgttaaaggagaaaacttacttcgttctggaacgcctgagtcgttcaatgttttgattaaagaaatgcaaggtctagggctcgatgttcgccctatggtagtagatgcttaa

SEQ ID NO: 90 - DNA, 393 bp, Chlamydia muridarum
gtgacaacagaaagtttggaaactttagtagaacagttgagcggcttgacggtgcttgaattgtctcagcttaaaaaaatgttggaagaaaagtgggacgttactgctgctgctcctgtagtagctgtcgctggtgctgctgctgctggtgatgctcctgcttctgcagagcctacagagtttgctgtaattctggaagacgttcctgctgataagaaaatcggggttctgaaagttgttagagaagttactggattagctttgaaagaagctaaagaaatgactgaaggattacctaagacagttaaagaaaaaacttctaaaagtgatgcagaagacactgttaagaagttacaagaagctggtgctaaggctgttgctaaaggactgtaa

SEQ ID NO: 91 - DNA, 2037 bp, Chlamydia muridarum
gtgagacactccatatatcaattagattctgctgttgagaatgtatttaggttggcatggactttaagattctctgagcggaagatgttgttgttatctcgtcaaagtggttcgggcggctcctttcaactatcttgcgctggtcatgagcttgcaggcgttgtggcggcaaagagtttgattccaggcaaggactgggcatttccttactatcgggaccaaggattccctctagggttaggatgtgatctttctgagatttttgcttcttttttagctcgaacgacacaaaatcattctgatggcagaatgatgccctaccattattctcataaaaaacttcgtatatgttgccagtctagtgtagttgggacacagtttttgcaagcagctgggcgtgcctgggcggttaaaaattctgggaaaaatgaagtcgtttatgtatcgggaggggacggatctacttcgcaaggggaattccatgagatgttaaattttgcatctttgcatcagctcccgcttgtgattgttatacaaaataatcaatgggcgatttcagttccttttgctgatcaatgtggagcagatttggtagcgcttgggaagagctattctggccttgcgacatacaaagtagatgggggggatctgtctgcgttgacacaaacttttgattgcgcagtttctgatgcaagacatcaccatattcccgccttagtaatcgtcgatgttgtgcggttggagtctcatagcaattcagataaccagactaaatatcgttctgaagaagaattgctgtactgtcaagaacaagatcctttggttcgtttagaaaaatctctgattgatgattttggagttgctcaagagactattgagcaaattaaggaagagcttcaagaaacgattagcaaggcttgtgagcttgctgagtctacgcctttccattgtaaaggggctaccaaacatgaggtttttgctccctataatgtttccttgatcgactatgaaaattccttagagtccgcttctttacagggatcagagcctcgggttatgcgtgatgcgataaccgaggctttggttgaagagatgcatagagatcccggtgttgttgtttttggtgaagatgttgctgggaataaaggaggggtttttggggttacaagaactctgacggagcgatttggaagaaatcgttgtttcaatacacctttggcggaagctaccattattggaactgcgattggaatggcttttgatggcttccataagcctgttgcagagattcaatttgctgattatatctggccaggtatcaaccagttgttttctgaggcagcgagtatctattatcgctccgcaggagagtgggagatgcctattgtgataagaactccttgcggagggtatattcaaggggggccttatcattctcagaatatagaagcttttcttgcccattgcccaggattaaaggtagcatatccttcaaatgctgctgatgcgaaagctttattgaaagcagctattcgtgatcctaatcctgtagtgtttttggaacacaaggccttgtatcagcgacgggcatttagtacaacgcctgtattttcttctgattatgttcttccttttggtaaagctcgtattgtgcactcaggaacggatttaacgattgtttcttggggaatgtccctagttatgagtgtagaggttgcgaaggatcttttaggattaggggtctctgtcgaggtgattgatttacgaacaatcgttccctgtgattttgctaccgtgtgtgaatctgtgaaaaagacagggaaattgctggttgttcacgaagcttcagagttttgtggctttggtagcgagcttgtggctttggtagcggaaagagcttatagatatctagatgctccgatcaaacgtataggagggcggcattcccctattccttattccaaggtgttagagaatgaagttcttccacagaaagaaatgatctttcaagaagcgaaatcattggcagagttttag

SEQ ID NO: 92 - DNA, 2460 bp, Chlamydia muridarum
gtgaactcgacgaataatacagactctcaaaatctggatccgaatgcttcagaagtcgaaaaacttcttgatgaatccgctgaggcagaagagaagacagatgaccatactcccccctcagaactttttattcttcccctgaataaacgtcctttcttcccaggcatggcagccccactgctaatagaagcaggtcctcattatgaagtgcttactctgcttgctaaatcttcccaaaaacatatcggtctcgttctaactaaaaaagaagatgccaacaccttaaaaattgggtttaatcaacttcatcgagtcggcgtatctgcgcgcattttacgcattatgcctatcgaaggaggcagcgcacaggtattattgagtatagaggaccgtattcggatcgttaaacccgtacaagacaaatatctaaaagccaaggtcgcataccataaagaaaataaagaactgactgaagagctaaaggcttactctattagcatcgtatcgattattaaggaccttttgaagctcaacccactattcaaagaagagcttcagattttcttggggcactccgattttactgaacctggtaagttagcagatttttcagttgctctaactacagcaacacgagaagagcttcaagaagttttagaaacgactgatatgcacgatcgcatagacaaggctcttgttttacttaaaaaagaacttgatctaagtcgactacaaagcagcattaatcaaaaaattgaagcaaccatcacaaaaagtcaaaaagagttcttcttgaaagaacaactaaagactataaaaaaagaattaggtcttgaaaaagacgaccatgctgttgatctcgaaaaatttatggaacgtttaaacaaacgagatgttcctcagtatgcgatggatgttatccaagatgaaatggataaactacagacattggaaacctcttcagcggaatatgctgtctgccgcaactatctcgattggttaaccattgtgccttggggaatccaaaccaaggaataccatgatttgaaaaaagctgaatctatcttaaacaaagaccattatggtttagaagatatcaagcagcgtattcttgagttaatcagtgtaggcaagttagcgaacggaatgaaaggaagcatcatttgcctagttggtcctccaggagtagggaagactagtattggtcgaagcattgcaaaagttcttcaccgtaaattcttccgattttctgtaggaggaatgcgcgatgaagctgagattaaaggccatcgtcgaacctatattggggccatgccaggaaagcttgtgcaagctttgaaacagagtgctatcatgaatccggtcattatgattgatgaggtcgataagatcggttccagctatcatggagaccctgcttctgcgcttcttgaagtattggatcctgagcaaaacaaagatttcttagatcattatttggacgttcgcgttgatctgtccaacgtgcttttcattttgacagcaaacgtattggattccattccagacccgttattggaccgtatggaagtattacgtttatccggatacattctggaagaaaaattgcagatagctaccaaataccttgttccgcgagcaaggaaagaaatgggactttccgcacaaaacgtctccttccagcctgaagctctcaaacatatgatcaataactatgctagggaagcaggcgtgcgtacacttaatgaaaacattaagaaagtattgcgaaaagtggctctaaagattgttcaaaatcaagagaaaaatccttctaagaaatctcggtttacaattacgccaaaaaatctacaggattatctcggcaaacctattttttccagtgatcgtttctacgaaaaaactccagtaggagtcgctacgggcctggcctggacttctttaggaggagccaccctatacatagaaagcgttcaagtcccctcgtcatcaggtaaagctgacatgcatctaactggtcaagctggagacgtcatgaaagagtcgtcacagatagcctggacgtaccttcacagcgctctagaacgttatgctccaggacgaccattctttgaaaaatctcaggtccatattcacattcctgagggagctactccgaaggatggcccttctgcagggatcactatggtaacctcgttactttctttacttttggatgttcccgtcctgaataaccttggcatgaccggggaactcaccctaacgggaagagtattaggcataggcggtatacgagagaaactcattgcagcaagaagatctaaactcaatgttttgattttccctgaagataatcgccgagattatgacgaactccctgcctatcttaaaaaaggcttgaaggtacacttcgttacgcactatgacgatgtgttcaaaatagctttccctggggtctaa

SEQ ID NO: 93 - DNA, 546 bp, Chlamydia muridarum
atgattagagatcttgagtattatgatagcccgattttgcgtaaagttgcggctcctatagatgaaatcacggatgagctacgacaacttgtactagatatgagtgagactatgactttttataaaggagtgggactcgcagctcctcaggtaggacatagtgttgctttattcattatgggcgtagaaaaagagctggacgatggagagctcattttctgtgatttcccaaaagtattcattaatcctgtgattactcaaaaatctgagcagttagtttatggaaatgaagggtgtttgtctattccaggattgagaggagaagtggctaggcccgataaaattacggtaacagcaaaaaatttggatggccaaccattttctatgactctagagggttttttggcgagaatcgtcatgcatgaaaccgatcacctgcatggagtcctctatatcgatagaatgtctgataaagacaagacgaaacagtttaagaataacctagagaaaattcgccgaaaatatagtattttgcgaggcttatag

SEQ ID NO: 94 - DNA, 588 bp, Chlamydia muridarum
atgccttacggaactcgttatccaacattagcttttcatacaggaggcgttggcgaatctgatgacggaatgcctcctcaaccttttgaaactttctgctacgattcggccttacttcaagcaaaaatcgaaaatttcaatattgttccctacacttcagttttacccaaagaattatttggaaacatccttcctgttgatcaatgtacaaaatttttcaagcatggtgccgtgttagaagtcattatggctggtaaaggtgctgctgtcgcggaaggaacacaggcaatagcaacaggagtaggcatctgttgggggaaagataaaaatggagacttgataggcggttgggcagctgaatatgtcgaatttttcccgacctggatcgatgatgaaatcgctgaatctcacgcaaaaatgtggttaaaaaaatctctgcaacatgaacttgacctgcgttctgtaagcaaacacagtgaatttcaatatttccataactatatcaatatcaaaaagaaattcggattttgcttaacagctcttggcttcttaaattttgaaaatgcagatccagttgttatccaataa

SEQ ID NO: 95 - DNA, 780 bp, Chlamydia muridarum
gtgagtatgtatataaaaagaaagaaagcttggatgactttcttagcaattgtctgtagtttctgtttggcgggctgttcaaaagagagcaaagactctgttagtgaaaaatttattgtaggaactaacgcaacgtatcctccttttgagtttgttgatgaaagaggtgagacggttggctttgatattgatttagctagggagattagtaaaaagctagggaaaaaattagaagtccgagaatttgcttttgatgcactcgttctcaatttaaaacagcatcgtattgatgcaattatggcaggggtgtccattacgtcttctcgattgaaagaaattttgatgattccctactatggcgaagaaataaagagtttggttttagtgtttaaggatggagactcaaagtctttaccactagatcagtataattctgttgctgttcaaactggcacgtaccaagaggaatatttacagtctcttccaggggtgcgtattcgctcttttgatagtactttagaagtgcttatggaagttttgcatagcaagtctcctatagctgttttagaaccgtctattgcgcaggtcgttttaaaagattttccgacgctcactactgaaacgatagatcttcctgaagataaatgggttttagggtatggaattggagttgcttctgatcgaccatctctagcttctgatatagaagctgctgtacaagagatcaagaaagaaggagtgttagcagagttagagcaaaaatggggtttgaacggctaa

SEQ ID NO: 96 - DNA, 381 bp, Chlamydia muridarum
ttgcgaagaagcactgaatttggtgttaaaacagcagggggtagtatgactacaatttttgaacgaattatagagggagctgtagagtgtgataaggtttttgaggatgaaaattttatcgtgattaaggataaatttcctcaagcaccagtgcatttgctcattattccaaagaagcatattgaaaaattacaagatatgcaaagcgacgatttttccttgctttcggaagctgggaagattattcagttgatggcccgtgatttcggtatagaaaatggatatcgtgttgttatcaacaatggcttagaaggagggcagagcgtattccatctacatatccatcttcttggtggaggcttgttaggctccatagcataa

SEQ ID NO: 97 - DNA, 1977 bp, Chlamydia muridarum
gtgttcaatatgagcgaaaaaagaaagtctaacaaaatcattggtatcgacctagggacgactaactcttgcgtctctgtaatggaaggtggccaacctaaagttattgcctcctctgaggggactcgcactactccttctatcgttgcttttaaaggtagcgaaactctcgtggggatccctgcaaaacgtcaagcagtaacgaacccagaaaaaacattagcttctactaaacgattcattggcagaaaattctctgaagtcgaatctgaaatcaaaacagttccctataaagtagctcctaactccaaaggagacgctgtttttgaagtagaaaacaagctgtacactccagaagaaattggagctcaaatcctcatgaaaatgaaggaaacagcagaagcttatcttggagagactgtaactgaagctgtcatcactgtacctgcttattttaacgactctcaaagagcctctacaaaagatgctggacgcattgcaggactcgatgttaaacgcattattcctgagccaacagctgctgctcttgcttatggtattgacaaagagggagataaaaaaattgccgtctttgacttgggaggaggaactttcgatatctctatcttagaaattggtgatggagtctttgaagttctctcaacaaatggtgacactcacttgggtggagatgatttcgatgaagtaatcatcaactggatgttaggtgaattcaaaaaacaagaaggcattgatctaagcaaagacaacatggctttgcaaagattaaaagatgctgctgaaaaagcaaaaatcgaattatccggtgtatcttctacagaaatcaatcagccattcatcacaattgatgctaatggtcctaaacacttagctttgactctaactcgtgctcaattcgagcatctagcttcttctctcattgagcgaacaaaacagccttgtgctcaagctttgaaagatgctaagttgtccgcatctgatatcgatgatgttcttcttgttggaggaatgtctagaatgcctgcagtacaagcagttgtaaaagagatttttggtaaggagcctaataaaggcgtcaatccagatgaagtagtggcaattggagcagccattcaaggaggagttcttggtggagaagtgaaagatgttcttctgcttgatgtcattcccctctccttaggaattgaaactctaggaggagtcatgactcccctcgtagagagaaacacaacgatccctacgcagaaaaaacaaattttctctacagcagctgacaaccagccagcagtaactattgttgtgcttcaaggtgagcggcctatggctaaagacaataaggaaattggacgttttgatctaacagacattcctccagctcctcgtggccatcctcaaattgaagtaaccttcgatattgatgctaacggaatcttacatgtatctgctaaggatgctgctagtggacgtgaacagaaaatccgtattgaagcaagctccggattaaaagaagaagaaattcaacaaatgatccgagatgctgaactcaataaggaagaagataagaaacgcagagaagcttcggatatcaaaaatgaagccgatggaatgatctttagagcagaaaaagcgattaaagactaccaagataaaattcctgcagatcttgttaaagaaattgaagagcaaattgagaaagtacgtcaagctgtaaaagaagatgcttcaacaacagctattaaagcagcttctgatgaactaagtgctcgcatgcaaaaaatcggggaagctatgcaggctcaatcagcctctgctgcaaatgctcagggagggccaaatattaactccgaggatctgaaaaaacatagtttcagcacgcgacctcctgcaggagacaactcgtcttctacagataacattgaagacgcagatgttgaaattgttgataaacctgaataa

SEQ ID NO: 98 - DNA, 765 bp, Chlamydia muridarum
atgcatgacgccctccaaagtattttggctatccaagagctcgatattaagatgattcgtttaatgcgagtcaaaaaagaacatcaaaatgagctcgctaaaattcaagctttgaaaacggatatccgttacaaggtagaagagaaagaacaagaaatggagaagctgaaagatcagatcaaagctggagaaaaacgcattcaagaaatttctgatcagatcaacaaattagaaaatcagcaagctgctgtaaagaaaatggatgagtttaatgctctaactcaagaaatgactgcagcaaataaggaacgccgaactttagaacagcaactcagtgatctgatggataagcaagctagcggcgaagatcttctcatctccttgaaagaaagtctatcttctacagaaagtagtagcagtgcaatcgaagaagaaatccgagaaaatattcgaaagattaatgaagagggtcgttctttattaagtcaaagaactcagctaaaagaagccacggatccagagttattcagcgtttatgaacggcttcttaacaataaaaaagaccgcgttgttgtcccgatcgaaaaccgtgtttgcagtggctgtcatatagcacttacccctcaacatgaaaatctagtacgtaaacaagaccatttagtattttgcgaacattgttcaaggatcctttactggcaagaactgcaagctacatcggcagagggatccactacaaaacgtcgtcgtcgtcgtactgcagtgtaa

SEQ ID NO: 99 - DNA, 1278 bp, Chlamydia muridarum
atgatggcttgcaaccaagaacttctttcgcctagaggcttagatttgctcagcaaaaattctcattctaatcttactcctacgatattctatccgtcggaccacaatattgatctgcaaagcttctctcctcatgccctttccgttgtgagaactttaaaaaaagctgggtatgaggcctatatcgttggaggatgtattcgtgatctcctactaaaaacggagcctaaagatttcgatgtctctacttctgccaaacctgaagaagttaaagccttattcaaaaattgtattctcgtaggcaaacgttttcgtttagctcatatccgcttccccaatcaaatcatagaagtctctacctttagatccggtagtaacgaagaagattctttaattacaaaagataatctttggggatccgctgaagaggatgtactgcgaagagactttactattaatggccttttctatgatccgagctccgaagtcatcattgactacacgggaggggtggaagacttaaaaaatcgctatttaagaaccattggcgatccttttctccgattcaaacaagaccctgtgcgcatgctgcgcctattaaaaatcttgtctcgctacgcctttactgtggatccaaaaactcttgaagctcttcgagagtctcgccatgagctaataaaaagctctcaaccaagagtatttgaagagcttataaaagtattaagctccggagaatccactatttttttccagctagcttcagaatatcggatcttagaaattctgttcccttatatgtctaaagcttttggcttaagcaaagttctccaagatcagacttttgctagcttaacggctttggatgctaaagtgcggcagcgttctttctgcttagaaagacatcttctgttgtcgatattgttgttccctatcgtaaacttcaatgttcgatataaatatagtcagcatccaacaatgtctattcaggatatttttgattatattaaaaactttttaacagaattttttgccgactcttttaccagctgctcaaagaaaaactttattttgacaactttacttttacagatgcagtataggctgacccctctagctccattaaaaaaagaaagaaattcgttcttcaataaaaagcttttacgccatacctactttcttgaagctctttacttgttagaaatccgcagtcaggtatttccaaaagtaaaagctccgtatgaggagtggctcaaccagtatgaacgaatttcggagtaa

SEQ ID NO: 100 - DNA, 486 bp, Chlamydia muridarum
ttgcttattttggatcgatcttctcctcaaatttttatttccaatgaacaacaggacgttgatatagatttacaatctgttcagcgtcttgttattttgtttttggaactgcaaaaagtctctacagatcaggtatacatttattttttgagcgatgccgctcttgctcagttacacgatgagcaattttctgatccctctctcacagacactatcactcttccgatagatagacctggcatccaatctttccctcacgtcttaggagaagctttcgttagccctagagcggctatgcgattcttagggcaatacacagaagcccaactataccatgaaatctcccgttatgtagtccattccttgctacacatgctaggatacgatgatcaaacagatgaagataagcgtattatgcgagaacaagaagattcttccctaaccttcttagctcagaaccaagcactgttgcatcctactgtataa

SEQ ID NO: 101 - DNA, 318 bp, Chlamydia muridarum
atgaagcagcaaaaacaaagaattcggattcgcttgaaaggttttgatcaagggcagctcgatcagtctacagcaaacattgttgagactgctaaaagaaccggagctcgtgttgttggtccaattcctttaccaacgaagagagaggtgtatacggttttgcgctcccctcacgtagataaaaaatctcgtgagcagtttgaaattcgtacacataagcgattaattgatattttagatcctacaggaaaaacaatcgatgctttgaagatgttgtctttgcctgctggagtcgatattaaaattaaggctgcttaa

SEQ ID NO: 102 - DNA, 2085 bp, Chlamydia muridarum
atgagcgatcaagagttcggtttagacgcgattagaaatatcggtatcatggcgcatatcgatgcaggaaaaacaacaacgacagagcgaattcttttctacgcgggaagaactcataagattggggaggttcatgagggcggagctaccatggactggatggagcaggagcaagaaaggggaattacgatcacctccgctgctacaaccgtattttggttgggatccaagatcaatattatcgatactcccggtcacgtcgatttcactattgaagtagagcgttctttgcgcgtgcttgatggtgctgttgccgtttttgacgctgtttccggggttgagcctcaatctgaaactgtttggcgacaagcaaacaaatatggcgttcctcgagttgcttttgtaaacaaaatggaccgtatgggcgcaaattattttggcgctgttgagtccatgagagagaaacttggggcaaatgctattccagttcactgtccaattggtgctgaaagccaatttgtgggaatggttgatttgatttctcaaaaggctctttacttcctagatgattctttaggagctaagtgggaagagcgggaaatcccagaagatcttcaagagcagtgcgaagtcctaagaatgcagttgcttgaagagttagcaactgttgacgaaactaacgaagcctttatggagaaagtccttgaggctcctgagagtattacagaagaagaaattcacagagtaatgcgtaagggagttattgaaggcaaaattaatccagtcctatgtggaagtgctttcaaaaacaaaggggttcaacagcttcttgatgtgatcgtcaagtggttgccttctcctcttgatcgtggtaacgttcgtggaatgaatttaaagacaggtgaagaagtttgcttgaagccttcgaaagatgggcctttagctgcgcttgctttcaaaattatgacagacccttatgttggtcgtattactttcatccgtatttattcaggaacattgaaaaaaggttctgctattcttaattctactaaggataagaaggaacgtatttcaagactgttagaaatgcatgctaatgagcgtactgacagagatgaatttactgttggggatatcggggcatgtgtaggtcttaagttttctgtaacgggggatactctctgtgatgaaaaccaagagattgtattagagcgtattgaagctcctgagcctgtaattgatatggcaattgagcctaaatctaagggagaccgagagaaattagctcaggctttaagtgctctttctgaagaggatccaactttccgagtttctacaaacgaagaaactggtcagacaattatttctggaatgggagagttacatcttgatattctccgcgatcgtatgatccgagagtttaaagttgaggctaacgttggtaaacctcaggtttcctacaaagaaacgattacgaaagcaagtgatagtgaaacaaagtatgtgaagcagtctggtggtcgaggacagtatgctcacgtttgcttggaaatcgagccaaatgagcctggtaaaggtaatgaggtagtcagcaagatcgttgggggagtaattcctaaagagtacattcctgcggtaattaaaggagttgaagagggattaaattccggagttttagctgggtatggtttggtcgatgttaaggtaagcattgtattcggatcttaccatgaagttgactcgagtgaaatggcctttaagatttgtgggtcaatggctgtgaaagaagcttgtagaaaggcccttcctgtcattttagagcctattatgaaagtgacagttataactccagaagaccacttgggagatgtaattggagatttaaaccgtcgtagaggtaagattctaggccaagaagcttctagaaatatggcccaggtcaatgcagaggtacctttgagtgaaatgttcggttacatgacctcattgagatcattgacttcaggtcgagctacgtcgactatggaacctgcattctttgctaaagttcctcagaaaattcaagaagagattgttaagaagtaa

SEQ ID NO: 103 - DNA, 1950 bp, Chlamydia muridarum
atgaagagactcgctcgtttttgtcttctagccttaactttattcccacaacttgcgttttcctcagcccccctccgacaacaagatgtccgcaaaaccgtagaaaaattagtcgagcaccatattgatacaaaacatatttctccccacattttatcgagatctttggaagactatgctcgatcattcgattctcataaagcatacttaacccaagatgaggtcctaacatacgtcttttcagaaaaagcgacccattccttatttaaacaataccaagaagataatttcgcttcttttagagagttacatacttgtattcaacagagcatttcccgggtaagagagtggcgtactgtgtggttatcagatgctgttcgcgtcattcaagatgcttcctcacatactatcccaaaaaaaccaactacctggggatcttctattgaagaggtaaagcaaagacaatatgagcttcttctttcctatgcatctatctacctagaagatgctacaaaaaatcgctatcaggggaaagaacatgcactagtgagattatgtattcgccagattgaaaatcacgaaaatccttatataggaatcaatgaccatggactcaaaatgtctcttgaagaagaggccaatagcttccatattcgcatcattaaatccattgctcatagtttagatgctcatacagcctacttcagcaaagaagaagccctttctatgcgagctcagctggagaaaggtatgtgtggaataggggtagttctgaaagaagacattgatggtgtagttgttaaagaagttcttcctggagggcctgctgataaaacaggaagtcttcgtgtgggcgatattatttaccgcgttaatgggaaaaatattgaaaacaccccttttcctggagttttagattccctaagaggattaccaggatcttccgtcactttagatattcacagacaaaacaacgaccatgtcgttcaactacgccgagaaaaaattctcttagatagccgccgtgttgatgtatcctatgaaccttacggtgacggcattatcgggaaaatcaccctacactccttttatgaaggagaaaatcagatatctagtgaacaggatttacgacgagctattcgagaactgcaagaaaaaaaccttcttgggttagttcttgatattcgagaaaacaccggaggatttttatctcaagccatcaaagtttctggtttgttcctaaccaatggagttgttgttgtctctcgatatgcggatggatctgtaaaacgctatcgcacgatttctcctcaaaaattttatgatgggccattagctgttttggtttctaaaagctctgcttccgcagcagaaattgttgcacaaacacttcaagactatggtgtagcccttattgtcggagataaacaaacctatgggaaaggaaccatacaacaccaaacgattacagggaacaactctcaagaagatttctttaaagtaactgtagggagatactattctccttcagggaaatccacacaactggaaggtgttaaatcagatattgttatcccctcccgatatgcggaagacaatctaggtgaacgttttttagaatatgctctcccagccgatcaatatgagaatgttttgaacgacaatttaggagatctcgatatccatattcgtccctggttccaaaaatactattctccacatttacaaaaaaccgagcttacgtggagagaaatgcttccccaactcgtcgagaacagtcagcagcgtcttgaaaaaaacaaaaattttgaaatttttgttcaacatttgaaaaaaacagataaacaagaacaatcatttggaagcaatgacctgcaaatggaagagactgtcaatattgttaaagacatgattcttttgcaaacttcattaagatctcccgcacaataa

SEQ ID NO: 104 - DNA, 459 bp, Chlamydia muridarum
atgagcactacacccattgttagtggagtcacgagtcaaaacaattcatcggaaaatgtttctaataacgctagatccttaactctaaaagagcgtgcatcgaagatcctatcttctaccgcatttaaggtaggattagcagtagtggggatatttttggttattcttagtattgttttgctattcatattgcctgcaactgctgcgagcaatccaatttatctggctattccagctattttaggatgcgtgaacatctgtattgggattttatctatgaataagggatcttgttcagaagcgaagtggaagttgtgtaaaaacgtattaaaaacttctgaagatattttggatgatggggagcttaataattcaaataaaatatttactgatgacaatttaagtagggtggaggatattgttataaccctatctagtagaagaaatagtgtggcataa

SEQ ID NO: 105 - DNA, 1665 bp, Chlamydia muridarum
atgcgaataggagatcctatgaacaaactcatcagacgagctgtgacgatcttcgcggtgactagtgtggcgagtttatttgctagcggggtgttagagacctctatggcagagtctctctctaccaacgttattagcttagctgacaccaaagcgaaagagaccacttctcatcaaaaagacagaaaagcaagaaaaaatcatcaaaataggacttccgtagtccgtaaagaggttactgcagttcgtgatactaaagctgtagagcctagacaggattcttgctttggcaaaatgtatacagtcaaagttaatgatgatcgtaatgtagaaatcgtgcagtccgttcctgaatatgctacggtaggatctccatatcctattgagattactgctatagggaaaagagactgtgttgatgtaatcattacacagcaattaccatgcgaagcagagtttgttagcagtgatccagctactactcctactgctgatggtaagctagtttggaaaattgatcggttaggacagggcgaaaagagtaaaattactgtatgggtaaaacctcttaaagaaggttgctgctttacagctgcaacggtttgtgcttgtccagagatccgttcggttacgaaatgtggccagcctgctatctgtgttaaacaggaaggtccagaaagcgcatgtttgcgttgcccagtaacttatagaattaatgtagtcaaccaaggaacagcaacagcacgtaatgttgttgtggaaaatcctgttccagatggctatgctcatgcatccggacagcgtgtattgacatatactcttggggatatgcaacctggagaacagagaacaatcaccgtggagttttgtccgcttaaacgtggtcgagtcacaaatattgctacagtttcttactgtggtggacacaaaaatactgctagcgtaacaacagtgatcaatgagccttgcgtgcaagttaacatcgagggagcagattggtcttatgtttgtaagcctgtagaatatgttatctctgtttctaaccctggtgacttagttttacgagacgttgtaattgaagatacgctttctcctggaataactgttgttgaagcagctggagctcagatttcttgtaataaattggtttggactttgaaggaactcaatcctggagagtctttacaatataaggttctagtaagagctcaaactccagggcaattcacaaacaacgttgttgtgaaaagttgctctgattgcggtatttgtacttcttgcgcagaagcaacaacttactggaaaggagttgctgctactcatatgtgcgtagtagatacttgtgatcctatttgcgtaggagagaacactgtttatcgtatctgtgtgacaaacagaggttctgctgaagatacaaatgtgtccttaattttgaaattctctaaagaattacaacctatatctttctctggaccaactaaaggaaccattacaggaaacacggtagtgtttgattcgttacctagattaggttctaaagaaactgtagagttttctgtaacgttgaaagcagtatccgctggagatgctcgtggggaagctattctttcttccgatacattgacagttcctgtatctgatacggagaatacacatatctattaa

SEQ ID NO: 106 - DNA, 651 bp, Chlamydia muridarum
atgatttttactattgcaaagagccttgttcgcttactgtttcctctgttttacagaagaaaaatctttagatccaaagctagtgcttctgtgacaggggctgctattattgctgcgaatcatgtttcgtttcttgatcccataataatacctctctccttccctggtaaaatttatcatttggctaagtctggtttgtttgctaattctttcgcgcattggctttttcacgagttaggatgctaccccattagcaggaatgctggaaattctgcagccttcaaggctgcgcttaatatcttttctcgcggagaaaagctcattatttacccagagggaacccgtcattctgatggagaaattcaccaagggaaagtaggtgtgggaatgctagctcttaaaggaaatgtccctgtcattcctgtttatgttgctggaaccctcgaagcttttggaaaacaccaaaaattccctaagctctggaaaactttgactaccgtgatagggactcctatttcattccaagatctcattgacaaccctgctattgataaaaaagaagcttatcaattagcgaccgaacgcatcatggccaagattgcaaaacttcgtacttggttccagcaaggatgcatcggagaaattccttag

SEQ ID NO: 107 - DNA, 705 bp, Chlamydia muridarum
atgcaaatcatcctcccaggaatcgttctaacccactctccagcagaaaaacaacatgtcatagcaaaaatcttctctcctgcagggcttctctctgccttcgcaaaaaatggagcctctctatcctgtgattttcgagaatctctgctccctatttcgttcagcctttttaccattcaacatactcctcccaaaatgcgaaaagtactacaaggagaactgaaaaatccgttcacaacgattaaaaattcttatcgactattgcaaagcaccggaaaaatgattcaagccattctcaaaacacaatggcaagaaaaaccttccccccaactcttttctctttttttaaacttccttcaacgaatccctgaaactcctcatccttattttttttcttctatgttcctgcttaagcttttacaacatgaaggaagtttagatttatcccactcctgcactctgtgtaaaagctctttagaatcctcaactgtttatcgtcatgaaggatctctattttgtgaaaaacatgcacacgaaaaaactatcttatttagccaagaagaagagcaaattttaagaattattgtacaagcgaagaagtttcaagagcttatgtgtttagcagagttccctatcgatatcgactccaaaatcgactctctattttcctctttcctcacagaaaaaatgaacgttcttccctaa

SEQ ID NO: 108 - DNA, 792 bp, Chlamydia muridarum
ttgaatatgattcggagatctaggcggatctccgaggttagagtgaaatttaagtatttgcgtccattcagttttttggtcttggttgtcgtagcattttgctatgggtgttcaagggaaaaacaggagattcttgtagggagggatcccacctggttccctcaacaatttggtatatacacatcaggaattaatgcctttgttaacgatttagtgtcagagattaattataaagaggggctaaacatctctttagttaatcaagattgggtgcatctttttgaaaatttagatgataagaagactagaggggcatttacttctgttttcccttcagttgagatgttagcgcggtaccagttttctgatcctattttgttaaccggtcccgtacttgttgttgcagaaaattctccttatcaatctcttcaagatttggaagggaagttgattggggtgtataaatttgattcctctgctcttattgtacaaaatattcctggtgctgtgattaattcttatcagcatatacccatagctttagaagccttatctactcaacgttatgatgctttattagtgcctgtgattgaagccacagctttagtggagactgcttataaaggccgtttgcgcattgcttcagaacctcttaatgaggaaggacttcgtttagttatattgcggggaggaggagcggattccttattagagggatttaatgcggggttggcaaaaacccgtcgatccggaagatataaagcaattaaaatgcagtcacgtcttccctaa

SEQ ID NO: 109 - DNA, 1185 bp, Chlamydia muridarum
gtgtcgaccaagaaaacgacgaagagtgtagttatagctaaggagtttgggatgtcggataattcacataatttactttataacaaatttgagttgcctgaatcggtgaaaatgtctcccgttgaaggtgcagctggtggcattgataaagtagctcggtttgttgctgatcccttagagaagggaatggggcacacattgggaagcgccttgagacgtgctttattaatcggcctggaagctcctgctattgtctctttttctatgacaggagttttgcatgaatacatggcggtagaggggatcatcgaggatgttaccaatatcgttttgaatttgaaaggctctttgctcaaaaagtatcctttacaagattgtgaaggaggaagagcttcccaaaaattgcgagctacaatttctatcgatgcatccgatttagctgctgctggtgggcaaaaagcaattactttaggggatttgctgcaagaaggcacctttgaagctgtaaatcctgagcatgtaatttttacagttactcgtcctatgcaactagatgttatgttgcgggttgctttcggtagaggatatactccttccgagagaattgttctcgaagaaagagagatgaatgagatcgttttagatgccgccttctctcctgttgttttggtcaattatttcgttgaagatactcgtgttggccaggatacggatttcgatcgtttaatattgcaagtggaaacggatggtcgtgtagctcctaaagaggctgtagcttttgctacgcaaattttgagcaaacatttttctgttttcgaaaaaatggacgagaaacggatcgtttttgaagaagccatttctgtagaaaaagaaaataaagacgatattcttcacaagttagttttgggcattaatgagatagaactctctgtacgatccacaaactgtttgtctaatgccaatatcgaaacgataggagagctggtaattatgccagagcctcgcctgttacaatttagaaacttcggtaagaaatctctttgtgagattaagaataaactgaaagaaatgaaattagaattgggcatggatcttagccaatttggcgttgggctggataatgtcaaagaaaaaatgaagtggtatgccgagaaaattcggtcgagtaagaataccaagggataa

SEQ ID NO: 110 - DNA, 369 bp, Chlamydia muridarum
atgccacgcatcattggaatagatattcctgcgaaaaagaaattaaaaataagtcttacatatatttatggaatagggccagctctttctgaagagatcattgctagattgcagttgaatcccgaagcgagagctgcagagttgactgaagaagaagtcggtcgactgaacgctcttttacagtcggattatgttgttgagggagatttgcgccgtcgtgtgcagtccgatatcaaacgtctaattaccatccatgcttatcgtggacaaagacatagactttctttgcctgttcgtggtcagagaacaaaaacaaattctcgcactcgtaaaggtaaacgtaaaactgttgcaggtaagaagaaataa

SEQ ID NO: 111 - DNA, 402 bp, Chlamydia muridarum
atgggaattacgagtgattcaattgcaaatttattgacacggattcgaaatgctttgatggcagagcatttatacattgatatcgagcatagtaaaatgcttgaagccattgtaagaatcctcaagcaacacgggttcgttgctcactttttagtaaaagaagaaaatcgcaaaagactaatgagagtctttttgagatatggggaagatcgcagaccagtgattcatgctttgaagcgtgtatctaagccttctagaagggtatatgtttctgcagcaaaaattccttatgttttcggaaatatgggtattgccgtcctttcaactcctcaaggggttttagaaggttctgaagctagagctaagaacgttggcggtgaattgctttgtttagtttggtag

SEQ ID NO: 112 - DNA, 336 bp, Chlamydia muridarum
atgaagagacgtagtgtttgtgtcggtgacactgtttatgtgcttgctggaaacgacaaaggtaagcaaggaaaagttttacgttgtttgaaggataaggttgtcgttgaaggaatcaatgtccgagtaaaaaatattaaacgctctcaagaaaatcctaaagggaagcgtattaatattgaggctcctctccatatttccaacgtacgtttaagtatcgataatcagcctgctagactgtttgtcaaagttacggagaaaggacgggagctttggaataagcattctgatggcagttcttcattataccgattggtaagagagagaaagggttaa

SEQ ID NO: 113 - DNA, 417 bp, Chlamydia muridarum
atgttaatgcctaaacgaacaaaatttcgcaagcagcagaaaggtcagtttgctggattgagtaagggggcaacgtttgttgacttcggcgagtttggaatgcagactttggaaagaggatggattactagccgtcaaattgaggcatgcagggttgctatcaacagatatttaaaacgtaaagggaaagtttggattcgagttttccctgataaaagtgtaacgaaaaaacctgccgaaactcgaatgggtaaaggtaagggagctcctgatcactgggtagctgttgtccgtcccggacgtattttattcgaagtggcaaacgtttcgaaagaagatgctcaggacgctttaagaagagctgctgcaaagttaggaatcagaacacgattcgttaaacgtgtggaaagggtatag

SEQ ID NO: 114 - DNA, 882 bp, Chlamydia muridarum
atggcttctgtatgtgggcgattaagtgctggggtggggaacagatttaacgcatttttcacgcgtcccggtaacaagctatcacggtttgtaaatagcgcaaaaggattagacagatcaataaaggttgggaagtctgctgctgaattaacggcgagtattttagagcaaactgggggggcagggactgatgcacatgttacggcggccaaggtgtctaaagcacttggggacgcgcgaacagtaatggctctagggaatgtcttcaatggatctgtgccagcaaccattcaaagtgcgcgaagctgtctcgcccatttacgagcggccggcaaagaagaagaaacatgctccaaggtgaaagatctctgtgtttctcatagacgaagagctgcggctgaggcttgtaatgttattggaggagcaacttatattacaactttcggagcgattcgtccgacattactcgttaacaagcttcttgccaaaccattcctttcttcccaagccaaagaagggttgggagcttctgttggttatatcatggcagcgaaccatgcggcatctgtgcttgggtctgctttaagtattagcgcagaaagagcagactgtgaagagcggtgtgatcgcattcgatgtagtgaggatggtgaaatttgcgaaggcaataaattaacagctatttcggaagagaaggctagatcatggactctcattaagtacagattccttactatgatagaaaaactatttgagatggtggcggatatcttcaagttaattcctttgccaatttcgcatggaattcgtgctattgttgctgcgggatgtacgttgacttctgcagttattggcttaggtactttttggtctagagcataa

SEQ ID NO: 115 - DNA, 480 bp, Chlamydia muridarum
gtgaggaagaatattaaagataaaaagaaaacagtttctgccagttgtataaacgatcacatctataaaatatttcctaacgacttgaatacaaataatactatctttggcggattactcatgagtttattggatcggttagctttagtggttgccgaacgtcattgtgaaagtatttgtgtaacagctcttgtagatgctgtgcgtttttatgctcccgcttacatgggagaaaatctcatttgctgtgcttctgtgaatcgctcttggcgaacttctttagaagttggagtaaaagtttgggcggaaaatatttataaacaggaacagcgacatatcacttctgcgtattttacatttgttgcggtagacgaaaataattctcctgtggaaattccagagctagtccctgaaacccaagaagaaattcggcgtttccatgaagctgaccagagaagagcttcccgattgaaactgtga

SEQ ID NO: 116 - DNA, 498 bp, Chlamydia muridarum
atgacgctatcaagaaattctcataaggaagatcagctggaagagaaggttctcgtcgtcaaccgttgttgtaaggttgttaaaggaggccgtaagtttagtttttctgcgcttattttagttggcgatagaaaagggcgtttgggctttggattcgcgaaagctaacgagctaacggatgctattcgtaaaggcggggatgctgctagaaaaaatcttgtctctatcaattctcttgagggaggatctattcctcatgaggttcttgtcaatcacgatggagcagagcttttgttaaaacctgctaagccaggaaccggaatcgttgcgggatctcgcattcgtttaattttagagatggccggagtcaaggacatcgtggcaaagagtttgggatctaataatcctatgaatcaggtgaaagctgcttttaaagctctcctgacactctcttgtaaagatgatattatgaaaaggagagccgttatcaatgattaa

SEQ ID NO: 117 - DNA, 786 bp, Chlamydia muridarum
atggttttaaaaaaagcgcgtctgagaaatcgggtgcaactaaggaagaaacgaatgaaaaatatattaagttggatgcttatgtttgcagtcgccctgcctattttagggtgcgataataacggtggttcgcaaacatctgcgatggggaaagacatggtagaagattctgtactcacagacaatcaaaaattatcaagaaccttcggacatttgttagctcgacaattgagttccacagaagattttacattagatcttactgaggttattaaaggcatgcagtctgaaatagaaggaaaaagtgctcctttgacggattctgaatacgaaacgcaaatggctttagtgcagaaggcaagttttgagaaaaaatgttcagagaatttagcttctgcagaaaaattcttgaaagagaataaagataaagaaggtgtaattgagctagagcctaataagttacagtaccgtatcgtaaaagaaggaacgggacgagttcttacgggtaaacctaacgctttattgcactacacaggaagtttcatcaatgggaaagtttttgacacttctgagaaaaataaggaccctattttactgcctttgacaaaagtcatttctggattctctcaaggaatgcaaggaatgcgagaaggagaagttcgggttctgtatatacatcctgatttagcttatggaacatcaggacaattgcctccaaattccttactcatttttgaagtgaagttaattgaggcaaatgacgataatgtatccgttgcggagtaa

SEQ ID NO: 118 - DNA, 1398 bp, Chlamydia muridarum
atgaatgaagctttcgactgtgtagtgattggagcagggcctggaggctatgttgccgccattactgccgcccaagcaggattaaaaactgcgctaatcgaagagcgggaagctggaggaacctgtttaaaccggggatgcattccttctaaagctctacttgcatcggcagaaattgttgcccaaatacgccatgctgaccaatttggcattcatattaatggtttcagcattgactatcccgctatggtacaaagaaaggatactgttgttcgcagtattcgtgatgggcttaatggcttgattcgtagcaacaaaatcactgtgttttctggaagaggttccttaatttcttcaacagaagtaaaaattttgggggaaactccttctgtaatcaaagcacaatccattatcctggctacaggatctgaacctagagcctttcctggggtccctttttcccaacaatctcctagaatcttatgctcgacaggagttcttaacctaaaagaaatccctcaaaaaatggctattatcggaggtggggtcattggatgtgaattcgcttccttattccataccctaggatcagaagtttccgtcatcgaagcaagccaacaaattctagccctgaataatccagatatttcgaaaaccatgttcgataagttcacgcgtcatggcattcgctttatgttaggagcgtctgtgtcgagcattgaggatatgggtgatcgcgttcgactaactattaacggaaatattgaagaatacgattacgttctcgtatccataggacgtcgattgaatacagaaaatattggattagataaagccggtgtgatttgtgacgaacgcggagtcatccctacagattccactatgcgcactaacgttcctaatatttatgctattggagatatcacagggaaatggcaacttgcccatgtggcctcccaccagggaattgttgctgctcgaaatatagctggacataaggatgaaatcgattattctgcagtcccttccgtaatttttactttcccggaagttgcatccgtgggactttctccgacatcagctcaacaacaaggaattcctgtcaaagtaacgaaattcccattccgagccattgggaaagccgttgctatgggcgaatccgacggatttgctgccattatcagccatgaaacttctcagcaaattctaggtgcttacgttattggccctcacgcctcttctcttatttccgaaatcaccttagctattcgcaatgagctgaccctcccctgcatttatgaaaccatccatgcacatccaaccttagcagaagtttgggcagaaagtgcactattggccgttgataccccgttacatatgccccctactagaaaatga

SEQ ID NO: 119 - DNA, 987 bp, Chlamydia muridarum
atgtttcgttatactctttctcgatccttattttttatttttgctcttttttgttgttcggcatgtgacagtcgctccatgattgctcatggactcactggacgtgaggccaacgagattgtggttctcctagtaagtaaaggagtatccgcacaaaaagttcctcaagtagctggttcgtcaggagggggatcttcagagcaactttgggatatctcggttcctgcagcacaaatcacagaagctcttgctatcctaaatcaggcagggctccctcgaatgaaaggaactagcctcctcgatctttttgcgaaacaagggcttgtgccttctgaaatgcaagaaaaaatccgttaccaagaaggtctttctgaacaaatggctacaaccattagaaagatggatggtatcgttgatgctagtgtacagatttccttctctccagaagaagatcaacttccactaacagcctctgtttatattaaacacagaggtgttttagataatcctaacagcattatggtttcaaaaatcaaacgcttggtagcgagtgctgttcctggcctttgtcctgaaaatgtttctgtagtaagcgaccgcgcttcttacagtgacattactattaacggaccttggggcctctccgatgagatcgattatgtctccgtttggggcattatccttgctaagaattctctcactaaattccgacttgttttctatttcctgattcttctgctctttgttctttcttgcggccttctttgggttatttggaaaactcactcattaattggtgctttgggaggaacaaaagggttctttgatcctgctccatactcacagcttgctttcacacaaaataaggcagctgctgctaaggagacttcagaagcaacagaaagcacaggaggggctcagccagcatcagaagaatcccctaaagagaatgtagaaaaacaagaagagaataacgaggacgcttaa

SEQ ID NO: 120 - DNA, 708 bp, Chlamydia muridarum
ttggctttgccaaaggatccccacctcgtcaaaaggatgaaatttttcagtttaatatttaaagaccaagaggtcgtcccgaataaaaaagttctctctccagacgcctatactaccgtgttaaatgcccaagaacttctagaaaaaacacaagaagattgcgatgcttacacacagcatacgcatgaagaatgtgcaaatctccgagcagaagcaaaaaatcagggatttcaagaagggagtgaggcttggagcaaacagctcgcctttctcattacagaaacacaggctatgcgagaccaaatcaaatcctctctcgtgcctttagctattgcaagtgtgaagaaaattatcggtaaggaattagaaacaaaacctgagaccgtagtatctatcatttcagagtctttaaaagagctcacacaaaacaagcggatcgtgattcatataaatccccaggatcttgccattgtcgagcaacatcgcccagagttaaaaaaactcgtagaatatgctgatgtgcttttactctctcctaaagctagtgtgtcccccggaggatgcattattgagactgagactggcatcgtgaatgctcagcttgatgtgcaactagccgccttagaacaagctttctccgctgccttgaaacaaaaacaacctacagaaaccttttcaaccgatcagactcaaagcaaagaaggctag

SEQ ID NO: 121 - DNA, 444 bp, Chlamydia muridarum
atggcggacgagatacaaaaagagggctcctcacaagaaccatcgtcctctaagtttggttcattcaaacaaaaagtacgtgatttgcacgctagtcccaaagttggggggatgaagagatttttatctcatcatgcttgcgaggcaattagtggggctttaattgtttttgggattatagctaactgtgtatcttgggttgggggattattcgttgcttctggggtagtccttggtttttactccgagattctatctgtactgcaaaaccttcaaagctattatgctaagaatgggcctatcaaaaatgctttagtctgtggggtttctctttactggctaataaaggctccttcttttgtgctttcgtttatcgtgctttgtatcattgtagtgctgcttgctcaagggcaacgcaaagatacaactcatcacgatggataa

SEQ ID NO: 122 - DNA, 993 bp, Chlamydia muridarum
atgcattttctgttcacattactatgcttaacttcattactgactgtagtatcatttgatgccgctggggcacgtaagagagtcgcctattctaagctgttggaaagggaagaagttgtattttctgctcagcagtctgctatttccgaagtagtttatagggacaaacataaacgattatcccctcagatgaaaaaggaagagatttgtttgcaagaaaaggaacgggatagtgtaaccgttcgacagaagcgttatcgtttattagaggtgcctttttctcgtcctcctaataattccagattcaatttatattctttgcttaaagaatcacctgaagattatggggatacttattcggcatattccattttttcgcgattgctacatacgttatatgttcagaccgggatcattcctcaaggggcagaggatcgagtgattcgggcgttgcttgatcagaaggatataattattactcgtgcccgggaacagggggccgatagtatagaaaccttagtgctcccttctgaagaagcagggtggttgtatgcgatgttaaaggggactaaaacttctcggtctttactgcactttttgcattatgaggagaagaacacgaataagggtagattaaatctactatttgcagatccggttattcttcaggcgtttgtgagcgatcccagagcttatgcagaattagagcatgtgcgtcaagaagtgtgggcaagcgctcgacaacaggaacttgccgttaagacttacggtcaagccgctgcgttagaattttttaaaacaaggacagattttcgtacggaattacaggataagacgcaggtgattctccatcgatatgacttgctggttttgcttaataaaaaggtttttgattacacgttgggaactgcgggggattatatttttgtcctagatccagaaaatgggggagggggcagaagtcgttgcgtttcaagaagaaaaactaattaa

SEQ ID NO: 123 - DNA, 525 bp, Chlamydia muridarum
atgtttagaaagataaaagggaaacgttcgtttctactttcggaatttttagtagcttgcgtgctcattagcctactgctcggctctttagggtattggactcgtcggatatgggtatctcataaagagaaagcacatatctatagaacgtttctgcatgacggaaaaatgtatcggctgctcagagatatttttctatcaactacctctatagaagaagggcaagagctggtcttttcttttgatcgaggagtgtatgttgatccagatttagcaggtcttgttcaagggaaactcctttacgatcccaatgatcaagagctttctttagtgatatctagcgaaagaatggaggggcgtcaggaaacgtttccattgtggaaacaagtgctttctgtagaatggagagttcttcggcagcaggaattaggtaggagaacagatagggtgtatttgacgttggtaaggaaatcaggggctttaccaccaagaactctttcttatgtttttgcagtaggtgggtag

SEQ ID NO: 124 - DNA, 1476 bp, Chlamydia muridarum
atgtctctttcatcttcttcgtcttctgacagcaacaatctaagaagtgtcttatctcaagtcattacatcgactcctcaaggcgttcctaatgcagataagctgacagacaatcaggttaaacaggtccaacagactagacagaaccgagacgacctgaacatggaaagcgattcagctattgctggagcggctgggaaggatcgtgcatcctctgtttcccaaatggaaggccaagaggtcatagaacagcaaggattagccgctgggaaggaaacggcctctgcaagcacagcatcgctaactcagaacgcttccacaggagcagcttctcaaaaacgtgtagaagataccaacaaatctttagaactatcctctttaagttccctctcctccgtagatgcgtcccaactacaagaaattcagaacattgttgcttctgcaacgagatctactaacgagacttccctaaagaacttagatactccgggactacccaagcctacaacgacgcctcgccaagatgttatggaaatcagcttagctttagcgaaggcaattacagcccttggagagtctacgcaagcagctttggaaaatttccaaagcacgcaaactcaagcctccaatatgaacaaaatgtctctggaatctcaaggactcaaaatcgacaaagaacgagaagagttccaaaaattgcaagagatccagaaaaaagctggcaacaactccacgatggataccgttaacaaagtgatgattggagtgactgtcgctatcactgtagtttctgttgtagcagcactattcacttgcggtcttggtttaatcggaacagcagcagcaggagctacagcagcagcagcgggagccacagcaggggctacagcagcagcaacgacagcaacttctgtggcaacaacagttgcgacccaagttacgatgcaagcagtcatgcaagcggttaagcaagctatcattcaaggggtcaagcaggctattgtccaagcgattaagcaaggacttaaaaaagggatcatgcaagcgattaaacaggctataaaagctgctgttaaaactcttaccaaaaatattggtaaaattttcaacacagggaaaaatgccgttagtaaatccttccctaacctatccaaagtgatgaacactctgggaagtaaatgggtaacattaggagttggagcactgacagcagttccccaactcgtatcagggattggaaatctgcagctatctgacatgcaaaaagatcttgctaagattcaaaaagaggtcggagctcttacagcccaatctgaaatgatgaaggcgttcaccttgttctggcaacaagcaagtaagattgctgcaaaacaaaccgaaagccctagcgaaacacaacagcaagcggccaaaacaggagctcaaatagcaaaagctttgtccgcaataagtggcgctctagccgccgcggcttaa

SEQ ID NO: 125 - DNA, 768 bp, Chlamydia muridarum
atgaaaacaatcgctgttaacagttttaaaggcggcacagcaaaaacctctacaacccttcatttgggagctgctctagcccaatatcataaagctcgcgtccttctcattgatttcgatgctcaagcgaatcttacagcaggattgggtctggatcctgattgttatgatagccttgctgttgtcctgcaaggagaaaaacaaataagtgaggtcattcgttctattgactcttcagggctggatctcatccctgccgacacttggctggaacgtgttgaagtctcaggatctctagcagctgatcgctattcacacgagcgattaaaaacgattctttccacaatagaacaccaatatgactacgtcattattgatacccctccctccctatgttggctcaccgagtctgctctaatcgccgctcaacatgcgcttatctgcgccacaccagaattttatagcgtcaaaggtctagaaagattggcaaccttcatccaagggatttcatcacgacatcctcttaatatcttaggtgtcacgctatctttttggaattacagagggaaaaataatgctgctttcacagaactgatccaaaaaacgttccctgggaagcttcttaatacacgtatacgcagggatatcaccatctcagaagccgctattcatgggaaacctgtcttctcaacagctccttcagctcgagcctcggaagactatctaaaattaactgaagaactgctatttttgttaagggacatctaa

SEQ ID NO: 126 - DNA, 1878 bp, Chlamydia muridarum
atgaataagccttgtcgagtcattattattgggggaggacttgctggactctctgctgctatgcaacttgctgatagaggaatgttagtagagcttttctctttgacaaaagtaaaacgatctcattctgtatgtgcgcagggaggcatcaatgcagctttaaatttaaaggacgagaacgattctccttatattcatgcttacgacacgataaaaggtggagattttttagcggatcagcctccagttttggaaatgtgcttaactgctcctcgtattattcacatgttggataggtttggttgtccatttaaccgagatgctcaagggaatttggatgtacggcgtttcggaggaaccttgtattatcgcactgtattttgtggcgcctctacaggacagcaattgatgtacactatggatgaacaagtgcgtcgtcgtgaatgtcaagggaagattatcaaaagagagaatcacgagttcgttcgattaattaccaacgaagaagggcgagcttgtggtgttgttgtcatgaatttatttaacaaccgtttagaggttgtacaaggtgatgcagtcattattgcaacgggtggactaggagtgatttttaaaatgtccactaactcgactatttgcacaggagcagcaaatggacgattgtttatgcaaggcatgcattatgccaatccagaattcattcaaattcatcctacagccatacctggaatcgataagctccgcttaatttctgagtctgttcgaggagaaggaggaagggtttgggtgccggggtgttcatccaagaccattattttccccgatggttctcgacgtccttgtggggaaacaggtaaaccctggtactttttagaagaaatgtatcctgcctatggaaatttagtgagtcgagatgtaggagctcgggctattttgcaggtttgcgaggctgggatggggattgatgggcgttatgaagtatttttagacgttacccatttgcctatagaaactttgaacaagctagaggttgttttagatatctattataagttcacaggagaggatcctaaaaaggttcctatgagaattttccccgcggtgcactactctatgggaggtgcttgggtggattggccagcgagtgatgatgaggatcggaatagtcgttatcgacatatgacaaatatcccaggttgttttaactgtggagagtccgattttcaatatcatggagcaaatcgtttaggagcaaattctttattatcttgcttatatgcaggattagtcgctggagatgaagctgcgcgatttatcgaatcttttggaagcagtccctactcgcagcaagatcttaaacacgccttgcaacaggaagaagagctctcccaggaaattttatcgcgtaaaggaggggaaaacattttttccttacatgaagagatcgcgcgagtgatggttaataatgttaccgtgaaaagagagaataacgctcttgtagaaaccttgcagaagttaaaagagtttagggaaagattgaaaaaagtttccgtacatgattcttctcgatttgctaataagactttccattttgttcgacaaatggagcctatgttagaactagctttagcgatcactaaaggggcgttattgagaaacgaatttcgaggatctcattataaaccggaattcccgaaacgggatgatgtgaattggttaaaaacgaccattgctacctattctgtagacgagcctgaaatttcttataagccagtagacactcgtcatgtgaacccagaattacgagattatacacaacggggagagaaagacgtagtgttagagaatattccaacgaatattcatttccctatatag

SEQ ID NO: 127 - DNA, 2079 bp, Chlamydia muridarum
atgattcggaaatggagtgggattcttctttgtttgttgttcagctgtgcttcttgtttttgcatagaaggaaataatgagaaggcgactcctactgtagagcttgtgagtgaaagtgaacaagctgttaagggagaggttgttcgtattggggcgcttattgctatccctaaaggagagcatatctattggaagaatccaggaaagtttgggatgcctttaaagatttcatgggaccttcctgcaggatgtgagttgctagaggaacattggcccactcctgaaatttttgaagagcctggggatgtttattttggttataaacattctactatggttgttgctgatgttcgtgtttccaaagagttggaaagtagtcaattagagataaagtctcgagtagagtggctttcttgcggagaggcttgtattccagggtcttctgagagaacgcttgtattaccagtgggtccaggaccgttaatccataatggtaaagatgctgcagctttttctcgtgtgttagctgctcaacccaagcagttggataaagcaattaccatctcttatcagtcagacggattggatgttcttgtaaaggaagggccatcccatggggaagtcaaagcgtggttcattgcagaaaatacgcgggactttgcttatgctgagggagcctcagtaggtaaagagaatgaacgcgtgtggagacttaagcattttgaaggaaacatgcctaagggagcaagcttatccgggctccttgtgttcacggatgactcaggcagggtagtagcctcttatcaggtgcgcgatcatcaggtgcaacagctgccggcatggagttggggattcctttcgattcttcttatggcttttgttggggggatcttattaaacatcatgccttgcgttttgcccctgattaccctgaaggtatttagtttaattaagtcagcttcagatcatcattcctcttccgttgttagtggtgtttggttcaccctaggagctattgcaagcttttggggattagccatttttgctttgctattgaaagttttgggacaaaatattggttggggttttcaactccaagaacctatgtttgttgccgtcttgatcatgattctcttcctatttgctttaagctcattaggtatgtttgagatggggatgatttgtttaagcttagggaaaaaacttcaagaagaaggaggagcttctgcaaagaaacatcaacggtggggggcttttttcaatggagtattaacaactttcgttactactccttgtacaggcccgtttttaggctccgttttggggttagtcatggctgtttctttcattaaacagttagcgatttttaccgctataggattaggaatggcaagtccgtatctcttatttgcctctttcccacggatgttagccattttacctaagcctggtccatggatgggtacgttcaaacaattaacggggtttatgttactggctacagcgacctggttgatctggattttcggagtcgagacgagtacagcagcagtgactattcttcttataggactttggttggctgctataggagcctggattttaggacgatggggaacccctgtatctccgcgtaagcaaaggttgtgcgcttccatagcctttatcttttgtattacgagttctttatttatagcctctgtaggagtgcgttactttgatgaagatgcgtatcctgttcaaagctcccattggcaagccttttctcctgagaaattagctgaattacgagcaaaaggggttcctgtttttgtgaattttacagctaagtggtgtttaacttgtcaggttaacaagccgcttctttatgctaatgcacaagcttttgatgctatgggcattgccacattagaagctgattggacgaaaaaagaccctcaaattacggaagagttagcccgcttgggacgagcaagtgttccttcttatgtgtactatccttctgggaatagagctcctgtagttttgccagagagattatcgcaagcgactttagaggagatgatttttactaagtag

SEQ ID NO: 128 - DNA, 588 bp, Chlamydia muridarum
atgggatcactagttggaaagcaagctccggatttttcgggcaaagcgattgtatgtggagaggagaaggagatttctctttctgatttccgtggtaaatatgtgattcttttcttttatcctaaagattttacctacgtttgcccaacagagttgcatgcttttcaagatagattaggtgattttgaagagcgtggcgcggttgtgattgggtgctcagttgatgatatagagacgcactctcgttggctagcagtagaaagaagagcgggaggaatacaagggacccaatatcctttgttagctgatgactctttagaaatatctaaggctttcggggttttgaatcctgaagggtctgttgccttaagagcgacttttttgatcgataaagatggggttattcggcacgcagttattaatgatcttcctctaggacgttcaatagaagaggagcttcgtgttttggactcgcagattttctttgagaatcatggcatggtttgcccagcaaactggcaatctggagaacgtggtatggtgccttctgaagaaggactaaaagaatatttccagacgatagattaa

SEQ ID NO: 129 - DNA, 2628 bp, Chlamydia muridarum
atgtcttcttactatttaaatttccgtcccaatactgtatctggagaaggtttatttaaaatcaaactgacaaatccttgttcagattttaaaaaccgagcaaaaccagctattgatattgaggagttgaactctggactttatatacttagacgattgtctgtagctttagaagccgggtatcttggtgttggttctgtcattaacccagataataaaattttccctggtggagaggggattgtaagaagatttcaggaaggcagtgttctttcttctagaacgatttctggtaacacggttgccgatattaaacaaagtacagctaagacgttagtcactacaatttcagatgggttgaatactttgatagaggatatccctgagcttcctatgactcaggtagggagtatatcggcagctctcattttaatggagacttataaatcaaaaccttctctgaatgagacagagcaaactacggtttttggtaatgcgtatgttccttctgatgaatccattaaagccatcatcaaaaaagaaatggaacaagaaatccaagagaagaaagatcttattatcaccgcacagttaacggcacaaggagcttccgatcaagcgattgaagagtcgttgagggattatgaggaattctatgtttctgagtattttaatacacatgtgaaagaagatctctggaaatatcgtgcaactattggggcaaatattcaggagatgttagaaaaatgttcggcattgggtccggatattccaacatctttaacaaaagataatgtcaaagaagctaatgctaagtcggtactgaaggcatggatggaagccttcagcaatgttttggaggtcgaaccggccttggggggatctcaagagatcattgaagctgtgcttaaaatgatcccttatgcaacaaaaaccactttaaccgacgaggatattcataagatttatgagcaagccgctttgccctctccagaggtgatggattattatctaaccaagcaagaggccgggatctgtaaaggagcggttgttaaggcgtttcagcaagctacgcagaacctacaagctgtgcgtgctgatgtaaaggagaacattgaagagttagaaatcaaaaaaacatctttccaacaagcacaggcatctttagaaagtatgttggaaggggttaagcgtttaaatgataacaaagcgtttacgtctgtaagattagcatctgtaatggagtgctactctgggcttatggcattgtcgcaaatgtctaatgttttagaaacaaatggaaaaacactcatcacggaatatgtaaatcgatttttacagttgaacaatacaaacacagcacaaactttagcacatgtaatatcttacatggcagcgtattgtgaggtggctgaatgtacaatggcgactacgtttttaaatcaaaccgaggtcattccatatgtaaacaacaaattccaagagcttcagcaacagccattttgtgctactttggcttctccaggcgtggcggaattaatgaagaattatatcgatttcacgaatggaatttgcaaagcgaatttcagcaatttcgtagataatgtgattacgaaagatttagatctttctgcagcagctaatcaggctcaggctatgcttggggagtttcagaaaaaagccgaagagtatctcaacacatttcaaaccgagatagataatctcaataaagtgtataacgagttggatccggcaaaggcaacattcaatgttggtattggaaatcaagagactttgcatgagaaagctgtaaataattggatcgagtctacaagtttagggtctgcttttatccatcttgttttgaatacacagattcctaaacaggaaaatttcttgaatcctttgattcaggaagtgaattttaataacgtagctgcaaacgctgttaatgaccttctgtcgattacaaataacttctcaacatcctctgtgtactataatttgtcctcttaccttgtcgagagtaaagagggggtagactatttttgtggagggttctttgagtttctttgtgctttcgctaaggagcgtgagtatatccttagggacatcaatagttgttatcgagctcaggcttttggaaacgctttgcttgcaagaatagaggctatggctgctggtaataaagtgactgcagctcaagcgaataacatgcgtacgcagacaaacttatacctggcttttattcggattattgttgaacagttgtcagttttagactctttgttaagaagtctaaattatcaacctctgcaaaaagatggtaattacgataaagataagtatgagattaaggggcccacggattggatttcgacactggctagtttggaaggttacgtcgttaatggatttgatagcgcaagtccttcaggtggtttagggcctatgcatacgctagtgcaaacagatcaacatgattatttaacacagagccagacccaacaattgaatttgcaaaatcaaatgacaaatattcaacaggaatggactttagtttccacctccttgcaagttctcaacgggattttatctcacttggctggggaaatttactctggctaa

SEQ ID NO: 130 - DNA, 2487 bp, Chlamydia muridarum
atgtcttctatgaacacatttaatagaattaactctatttcaaaagactacatgaaaatagaagatatttttctttctgcacccaagaacaaaacgttcttcatcaatcatgtcatgcagtttcaaaaaacagaaatagaacgaaatgctattcataaggttctctctcttttagacaatgacgtgcaggctcaatacgagcaactcgtaacttccctatcctccaacacattagctacaactgctcaaccaacaaaagattcatctgcaattacgtatgaccctccctcttcaaaccctctttacaatgccgctaagcaagcttgggcgcacaatgtattagctgattttctgaatgttgtaactgaagcaaaagcaaaagccgcaacaatctcacaaaatgaaacagacttaaaggctttaaccaatctatcttccgtattaactgctcttgtcaacaaagctaaagatggagagctttctcaagaaaactttgaaactttttatcttcttcccgaccaaatcttttctgctattcaatctttcccttttgaagggaatcaaaaagtactcttttctaatcagttattagctgcttttggagaagatggctctatagaacaaatattcgcagatatacgaatcgaagggcttcaagatgttttaaatatcgtccaatcaaaactgtctcccgaagagttcgagtccttccaagaattacaaactgtgatagatactctccgagaatatgttgaaccttttgacgcagaaggattcaataccattttacaagttagcgaagcattatctgtggctattataaaaacctccctccccagcaacgaaaaaatagaactttgccgtgatatcgctgatttttacaaggatcaagttttatctatccagcacttggacactgtattaaatgagacgatttatataaatgcgcgacacaactctcttttcgctgaaattgccagccttgttgcatttattatgggaagtttcgctcccgttggattgaacgcaactagcatagaagtgaccaatgcttcgattgcaggggctttacaagctgttcgcgcaattgatgctcgttttcatgaactctctcccgatcaacaacaattagtcaatgaaaccgttgcaaagctcaatgatttccatggaggtgagtatattggagctgtgtgggcctatttcatagcagcaaccaccatcgcttctaaaaattcagtgtcaccggatgaaattaaacaagtattaactgctcaagcaaatacgattgcttcttctttttctctgactcaaacactaaaaactacgattaataatattgtcgctaaaaatggccaatttgaaactgtagtcgatggagtagatcggcaatacaccattttcagcagcgattctaataatcaagctgttcttaacccaattcttctcaactttggatctataggatttttacctaatatcaccgaagcagcaaatacccattcagaaacttctgcgcgcgcattttttagattcaaagcgttagctcaaacagaaaatgcaaaattggacgctactctacaaggtagtgaagactttttaaaaaaaatcaaccagctaagaaaagatcttttttcttatcaactgcttgcacaatcacacgaaatacgctctcttcctctcccagcggctgtggcttcagtgttaatagatcgatacatgcctaaagaaatcgactatttaacacagatgaaatccgacctatattacagcaacttagggtctagtgttgggaacgctatgattgaagccatttctcaattcgtaaacggatctacatatttcaactttgcaagctttgctggccaacaaccaatgacagggatgcatacagataccttcccaggatcgcaagaaactgcagcagcaaaacttgctttagaaaaacaacaaaccaaactttttatacaatacactaatcaagcattagcggttgtacaacaacagctagctcgtgtcaaaaatgaccctgtaattaccaatgagcaacgactacgcattctggatgcgttaaatagttatgccgataacctaaattccatcaacggctctctagtcttattacaagtctatctcaatccattaagtgtgggagtacgtgatgggaaccagggcggaggtgatacaggaaaagaccctgaaggaactttccacgtatttggaggtcaagagcagtggcaagcgcgtttagagacactagaagatgctcttgtctcaggactcccttcgaatatcattaatggaggcttgttcccagtacaggcaactgtgcaagcagatcaacaagcttttgcggacatgggccaaaactaccaactagaaatgcaaatgcatatgactgctatgcagcaagaatggactgttgttgcaacatctctgcaaattcttaatcaaatctatctcggattgtccagaaaatttgctggataa

SEQ ID NO: 131 - DNA, 684 bp, Chlamydia muridarum
atggcaggtcctaaacatgtgctactagtaagtgaaaattgggacttatttttccaaacaaaaaaattacttaatcctgaagaatatcggtgtacgattggtcagcagtacaaacaagaagtatcagcagacctaattgtttgtgaatatgaattacttcccaaagatattcatgctcctaagtattttgaagctaactttgttatagttttattagatgtttttgatgaagagaagtgtatcgatcttttagatagaggattttggtttttggtgcagccaattactcctagacttctaaaagctgctataggtgcgtttctttctcaaggttctttgcattctgttcctgaaagtattcagtttggccctaatgtgtttcatattttgaaactgatagtggaaactccagaaggaactattcatttaactccatccgaatccggtattttgaaaagactgttgctgaaccaagggcaactttgtttacgtaaacatcttctagaggaaatcaaaaatcattctaaagagattgtagctagaaatgtggatgtacatatagcttctttaagaaagaaattaggcgcttatggaaatagaatcgtcactgtacgtggagtggggtatctattttccgatgacgaagagaaaaattcttcgcaagaagatacaaagctttcttaa

SEQ ID NO: 132 - DNA, 1590 bp, Chlamydia muridarum
atgttgagcaaagaaggtgatttttcaaaggagcaaagagagcgtttatcgcattttgtgactaatttggattcgccgatatttgctctgaagaatcttcctgaagtcgttaaaggtgctttattttctaaatattctagatctattttaggtttgcgagcgcttcttctaaaagagtttttagatggagaagggggagattttctcagtgaagaccttcaagattgtgaattaggcatccaaaaggctgcagatttctatcgccgtgtattggataactttggagatgattctgttggggagttagggggagcacaccttgctatagagcaagtatccatgcttgctgctaaagttttagaagatgctcgtatcggagggtctcccttagaaaagtcttccagatacgtttatttcgatcaaaaggtcaatggggagtatttatactatagagaccctattttgatgacttcggcctttaaagacacgtttttggatacgtgtgattttctgtttaacacttattccgaactcatacctcaagttcgtgcttattttgagaaaatttatccaaaagatcctgaggtttctcagtcggcttatacagtttctttacgagcgaaggttttagactgtttaaggggattattaccagcagccacccttaccaatttaggtttttttggtaacggtcgattttggcaaaatttattgcatcgtttacaggacaacaatcttgttgaagtgcgtaacattggggagcaggcgttaacagaattgatgaaaatcatcccttcttttgtaagtcgggcggagcctcatcaccaccatcatcaggctatggtggattatcatctaggattgagagaacaattaaaaagttttgctcagcgttatggagaagaaagggagccttctttagagaaaggagtaaagttggtttacggagaccctgatggtttatataaaatcgccgcagcctctatgttcccttactcagaacatacttatgcagatctgttagatatttgccgaaaaatccccgatgaagatcttatgctaattttagaatcgagtgcttcttctcgagaaaatcgccgacataaatctccccgaggtttggagtgtgctgaatttgcttttgatatcacagcagattttggagcttatcgggatttgcaaagacaccgtatcttaacgcaagagagacagttattaacaactaaactaggttactctatccctcaacaattgctagatactccgatggaggctccatttagagaggctatggaaaaagcagatcaggcttaccgtttaatagcagcagaatttcctgaagaagctcagtatgttgttccgttggcctataatattcgctggctcttccatatcaataccaggggattgcagtggctttgtgaattacggtctcaaccccaagggcatgaaagttacagacaaattgctatagacatggcaaaagaagtgatacagttccatccagcgtataaatcgttcttgaaatttgtcgattattcagaaacagatttaggaagactaaaacaagaatcacgccgcaaggcttaa

SEQ ID NO: 133 - DNA, 723 bp, Chlamydia muridarum
atgacagaacctcttacagatcaacaaataatacttgggacatcgacaactcctgtcgcagcaaaaataacagcttctgaagggatatccttaacaataacaaacaatgctcaagctaactcttcagtaaatattggattagatgctgaaaaagcgtaccaacttattttagataagcttggcgaccaaatctttgatggaatcacaggatccatagttgagagtgctgtacaggacattatagataagattacctcggacccttctctaggattgttgaaggctttctataacttccaaatcactgggaaaattcaatgtaacggcctattcacatctagcaatgtaacaactttattaggaggaacagaaataggtagatttacagtaactcctagaagttctggaagcatgtttttagtttctgcagatatcattgcatcaagaatggaaggtggagttgtattagccttagtaaaagaaggagatacacaaccatgtgcgattagctatggctattcttctggtgtgcccaatttatgtagcttaaaaacctgtgttactaattccggatcgacacccacaacttattcattacgaataggaggattagagagcggagttgtatgggttaatgctctatccaatggtaatgatattcttggaataacaaatacttctaacgtttcttttttggaggtgatacctcaaaaaaacacttaa

SEQ ID NO: 134 - DNA, 741 bp, Chlamydia muridarum
gtgaataaactggaaaaggaagctagcgtcttttttaaaaaaaatcaggaatccgtttctcaagactttaagaaaaaggtttcttcaattgagatgttttcaacttctttaaattcggaggaaaaccagagtctggatcggctttttttgtctgagactcagaatttatcagatgaagaatcttaccaagaagatgttttgtcagtaaaacttctgacaagtcaaataaaggctattcaaaaacaacacgtgctccttcttggagagaagatttacaatgcgagaaagatactaagtaaaagttgtttctcttcaacaaccttttcatcttggctagatttagttttcaggactaaatcatccgcctataatgcgttggcttattatgaacttttcataagtctaccaagcacaactttgcagaaagagttccaatcaatcccgtataagtctgcatatattttagctgctaggaaaggagacttaaaaacaaaagtctctgttatagggaaagtttgtggaatgtccaatgcatctgctatccgggttatggaccaacttcttccttcatctagaagtaaagataatcaaagatttttcgaatctgatttagagaaaaatcgacagttatcagatcttctcgtagaactgcttcgcattgtatgttctggagttttcttatctccttataacgaaaaccttctgcagcagttgtttgaagtctataagcaaaagagctga

SEQ ID NO: 135 - DNA, 2259 bp, Plasmodium falciparum
atgaatattcctcttatcattacgatactgttatttttattctaccaacattatgtatgtagtacaataaaaccatacgaaatagataaaagggatttattaaaaatatatgaagattataaaaatttggaattaagtaaagaggttgttttagataatgaagagagtttccataatataaaatatctgtctctatgtaatataaataataagaattcgatatccggaatatcaaatatactttgtaaaaatattaattttggttatcatataaaaataaaaggtgtagatcttttatatggtgagatagttcattttggtacatcgaaatttataaaggaaataaattttatatgtaaatattatatatatgataattcgtatgaaataataaaatgtaattatgttatcaaacttgatgagcattatgatttttatttagggtttgatatggaacatatatatgaacctaaatataagattgataaaaatcaaaacaacaacagaaataacaacaataataatgataataataataataataataattttattcaatcaaataatttacaaaataataatatgcattcattaaaggaacaagaacaaattgtattaaacaatgtaacatataacgaaaatatgaaaatagataataatacaaagaatatgtctcgaaataataatgatgataataatcataatattttttatcagaatgattatctcaattattataatagtcataatgtaaaaatgtgtaatttaaggattcctatttatagttatataacgaatgtagaagaaacgcttttgaaaattctgattggattatgtatcaaattaggatataagaggttcatgatatattctgaaaatacctttgttatttcaagttattttgaaaatatgtatattagtagagatatatttcatcagggatttaatataacttgtaggaaattttacaactctaataatatatatattattaagagtcaaaatagttttatacaaaataaaagtaatcataattataggagcaataataacatcgatgttgtgagaaaagaggttcctaagatttatgttaaattttttgctaataagtcttatttattgtggagagggattgaacagaataaagaaatctttaattttaaattattagaattaaaaaatttattaaaaaaagttaaatataaagaaaggatatatatatgctatactaaagaattatattcttattatgaacaagatgaaatctatattaaaaattttatgtcttctcataaaataaaatatcgtaatttcagatcattacaaaataaagataaaaaaaatttggatataccttattcttatatattattaacatttgaatatttttgtgatcatactattatattatttgaagaatgtgtacatattataatgacatcgaaaattttagatgaaaaatataaaagtattatgcatcaatttttatatgaaagttttctatgttctcaaaattgttcatatgaagatgaccaattaaatatttttcataatgatatgattatatcaacatttcaaaaatttataaataatagtaattctataatcgataaaatgaaaaaacaatctatatctataactgatcaaattaaaaagaaggaagaattttataataatatattattacctcaagatgaaaatatatacaaagaattttatgaaaatattatgttttctattgaatttaaatctttcatccctttgataaaagatgaactagataaacttagtagaaggaaaaatattagaaatgatagtaacaatagtaacaatagtaataatagaaataaccgaatttgtaatattttgaagtttattaaatatcatgaaaggttatatgaatctaatagccataatagtatatatagtcgattattaaatgaatccatattattaaataaattagtttttgaaaatcataaaggtgatcaccattttgatgacatttctatcatcaatctgaagaataatataaaattaaacaaagaaaatattaacacaaaaacaaataatgtggaagaaaatataaaaacaaacgaagaaaatattaacacaaaaacgaataatgtggaagaaaatataaaaacaaacgaagaaaatattaacacaaaaacaaataatgtggaggataatataaaaacaaacgaagaaaatattaacacaaaaacaaataatgtggaggaaaatataaaaacaaat

SEQ ID NO: 136 - DNA, 2256 bp, Plasmodium falciparum
gaagaaaatattaacacaaaaacaaataatgtggaggaaaatataaaaacaaataaagaaaatattaacattaaaggaaacaatgtggaggaaagtataaaaatcgtatataataaaaatgtggaaaataataaggctcagggaaatgaaaattttgaacatacgaataaaaaagaaataatatatattatgaatgatcctattcaatctaacaccacatataattccgaatcatatgaatctatttcaaacaatttagatgaaagtaatttgaataattatacttatgatgatgatgaaaaatatgatacggagcaaattaacacatttacaaaaaagtaccctaaaatgatgaatatgaaaatagataaaaaaaataaaataataaataataacgaattagaattaaaaaataataataaaggtaccatgcatcattctttcataattaattcttatggtgtatatatttatactttacaaaagcaatatgattatgatattctaaaaaaaatatatgatgaatataagaaaacacaagacaatacaaataatagtaataataacaatgatcatatgaaaaggaaagaattttttaatctactctattcaattaacaaaacatatacttttactgtcaataatgtacccacaaaaatatacgacatattaaacaaaacaaatattatttcaaaggataaaaaaaaagataataaagagcatcattcaaatatgtatgaatggggaaaaaaaaatgtaaaatacttctgcagtaaagagaaaaggtggccattttctaaaaaggaaattgatttttttacctctgatgatgctatttattgtgaggctcaatatgtaaacgagttcttaattactgtaaattatggagaacagacgtttgattatatgataaatgatatttatcaaaagggagatatgtttaaagatcaaaatatttatcaaaagggagatatgtttaaagatcaaaatatttatcaaaagggagatatgtttaaagatcaaaatattcatcgaaaggatgatgattatgaaaaaaatgaagatatacattcaaattcacattccgataaaaattcaaacattaattttatttttccagaaaaaattttacataaggtcaaagaagaatactttgtaaaacattccataaatgaaagcaaaattataggtttttatctacttaataatgcatgtgtaataaaatatattgggaataaaaaaaatgacataaataatccttttttaagtaatgttttattaaaatccgttttagggttttgtattttacatggatttacaaagttgaaagttgaagcagaaagtattaattatgaaagtggaataaaaaataaatttgtggagattttattaaatggatatactgaatatgaatatttaggtttgacgttaatgaatgtagctagattttcaaaagatttatattatattataacaggatatacttccaaaagtgatcttttattatctgctgttatgaaatttgaaaaaaattttaatatatatcataatatcgaaaataattttttgaaatatatgaacaaaaaatctatgaatttattacatgaattaacctttaattgtaatgatgattattatccatataaaaattgttatgatctttatcctctagtaagaaaaaatataaaaaatatatgtaatttcgaaacaaatagtatatataaagaattaaatttattatttcctgatgtgtgcaaaataggaaagaaaatagccttatgttatgaacaaattaaaaaatatattgtttgctcaaaaaatagccaagggtgtaaatactacaaatttataataaacacattcataaaaccaagaagaaaaacatccttttttattaatcataacataaacgttcaggaatatttatcaaaaaaggcatatacatattatttgttattatgtgaacttataaaaaataaagaaaaacaattaaaacaagaagaagggcaaaataaaaatcaaaatgtagaccatgcacatacttattttttattaaataatatcattcaatattccacattttttcttttctggaatttctctactgaattttggaagagatttcaatatatacataataatgatattcataatataaatgaaatttcttatcaaaataataacttgttattttgccccatggcatatgcctacgaatttatttatcaccttaatgtattttacataaacgaatag

SEQ ID NO: 137 - DNA, 2919 bp, Plasmodium falciparum
cccaaaagattggaaaatcgttttatcctgtacaacatgttaagggatcatataatcgagaaggaaggatttaaagacgttatcatatttgaaacggatgataacaatatttataattatgattcgaaattatctaaggatattcgaattttaagtaataaatttgagtttgaaattttaatggatgaacatgcttatataaataaaccttatgaatatttctatttaaataaatacatacctgtacattttgaattacaaaataagggtattataaattataataatatattttcttggttatgtgaacattttattaataattctcaatacaaatattattatcctcatttttatctttctaaacattctgataaaaatgatatgggcatacgtaatataagtttttaccagaaagaagatgcttatacttttatagaaaacaataaaaagaatataaataagaatgataaatgtaaaacatatgatacatgtgaaaaagatgatacatataggacagataaaaaaagtaaactaaaaaatattaatagaatatataacaccaaatatgcattgtcaaaaaaaaaaaatagaaaccataagaacaatgaaataaataatatatgttcccataaaaaagaagaaaaacatatgtttaataattataatataagttataataatatgaaatatataaataaacacaataaattttcatttctagaattaaaagaaaagttgaaaagtgataataatgaaagggaagataaaaaaaagaaagatgaatcatttgaaaaaaatgaaacccatctaatgaacaatgatgataataatattggtgatgatgaatttaattctgaagtaaataatgataataatggctcatatgaaagtaactttttttatgatatgattaacgaaatatctaacaaaattgaaaattcggattcatacttaaatgaagaagatatctattgggatgatgatattttttttgatactaatgaatatatagatgatactagtactattactactagtactaataataataatattagaactgatcaaaatggagacaataaaaaagatgattctaacaaagacattataagtatacaaaaggtaaatgattcaactgaggtaaatgaatctaataaaattgatgatacgaaaaaaggtgaaagttacactttaaataatattaagggatatataacaaaatttaaagatttcattcaaaataaatcagaaagttatgtgactactaagaataaaagtattgacgataaaagtagtgatgatcaaattagtgatgataaaattaatgatgataaaagtagtgttgatcaaattagtgatgataaaattaatgatgataaaagtagtgttgatcaaattagtgatgataaaagtagtgatgatatcaaattaaatgaagaacaaacttcgggagatcaaaatgacttatctgataataatgaaaataaccaagaaactataaccagtgatgatacattagaaaaaggaaaattagataatagtaacatgggtgatagtgacgaaaaattaaaagatgatatgaaaaataatgaacatgaaaatttatcagcagaaaatgtaccttctgatgaaaatacaatcaatgataaaacaaaagaaggcagtacaactttaaaaactgctatgggatatattacaaaatttaaagattttattcaaaataaatcagaaaattatatgaccactaaggataaaactagtgaagacaaaattaatgatgataaaagtagtgatgataaaattaatgatgataaaattagtgatgataaaattagtgatgataaaattagtgatgatatcaaattaaatgaagaacaaacttcgggagatcaaaatgatttgtatgataataataaagataaggaagaaactatatctagtgatgatacattagaaaaaggaaaattagataatagtaacatgggtgatagtgacgaaaaattaaaagatgatatgaaaaataatgaacatgaaaatttatcagcagaaaatgtaccttctgatgaaaatacaatcaatgataaaacaaaagaaggcagtacaactttaaaaactgctatgggatatattacaaaatttaaagattttattcaaaataaatcagaaaattatatgaccactaaggataaaaatagtgaagacaaaattagtgatgacaaaagtagtgatgatatcaaattagatgaaaaacaaaatgcgggagatcaaaatgatttgtatgataataataaagataaggaagaaactatatccatcgatgatgcattagaaaaaggaaagttagataagagtaacttgagcgataatgaagaaaaattagatgttagtaatgtgaaaaatagtgaagatgaaaatttatcagcagaaaatgtaccttctgatgaaaatacaatcaatgataaaacaaaagaaggtagtacaactttaaaaactgctatgggatatattacaaaatttaaagatttcattaaaaataaatcagaaaattatatgaccactaaggataaaaatagtgatgacaaaagtagtgatgatattaagttaaatgaagaacaaacttcgggagatcaaaatgatttgtatgataataataaatataaggaagaaattatatccatcgatgatacattagaacaaggaaagttagataagagtaatatgagtgataatgaagaaaaattagatgttaatcatgtgaaaaatagtgaagaaggaaatttatcagcagaaaatgtaccttctgatgaaaatacaatcaatgataaaacaaaagaaggtagtacaactttaaaaactgctatgggatatattacaaaatttaaagattttattcaaaataaatcagaaaattatatg

SEQ ID NO: 138 - DNA, 2529 bp, Plasmodium falciparum
atggaaaatcgcaaagttttgaggatagggaaaagtgtagtacacggtcgcacgggtcccttgagaggagacatggaggctgaagaacaaaaggaggtgagaaaaaaagaggagagtaataaaaaggatattataaaagaaaacaattctgataataaaaaggatgagcaatcaaaagtagaaacccagaatactgaagatattttaaataaacattataataaagaggatacagaaaataatagtggaaatatatttgaacaattattacaaagagaattagctaaaggtactttaggaggtggtgttgttgaaaagaatacaaataaactaaaatttcaaattgaagaaaataatattatggatactgctgatggaaatatagatgaagatatggaaaagttatcaaaaattagtttacaagaaagaataaatagtaccatagtaaaatatcgtatgcatgcttataatgaaatattgaaatgttttaataatcaagataatgataatcaaaagaattttttaatagataagaaaatacatattgtcaataatttttttaaagatgaagatagtatatttaaatacttatcagataataatttaatatgccaaataaaaacttctgaaattactgaagcttatttacatattataaaagatatttattttcataattacaaaaatgaatataataatgaagaagaattaattaattcatttgttaatgaatatcgaaataaattacataatatgtttttaaaaatatatattttattgatcgaaaaaatattaattaatacaaaatcttttgattttggttgtaatattattattaaaattatagaatattgttcatatgataaaattacactttctattattacaaccatttgtgaatatttaaattcaattttcttaaaagctaacaaaaatgtttctaatataaaaggtgtaaaaattaaagtcattgcctctattcttttattgttttataaattattacattcttttggtcctcacataatttgtgttaagactataaataaatattgtttaaaatttaatgagatgatggataaagctgtaaaaaccaacttctattctctatatatagaaatactaacccaagtaaatatacaagaatttcataattctatcttaaatgagttgagtagtcaacaaagaaattatataaataaagaattacaaaataaaccaaagcatacagataatacaactaatgcaaccactctatataaagcaacatatattttaaaaactaatgatcataataattcttacaattttatgaaaaatttcaatggtaatacatctgctgggaacggattagataatcatattgttgaagaatttgatgttttcaaagacatatgtacaaaacaatgggaaaagagagttctggaaggatgtattgataaaaataatagtactaataatacaaataataatagtaatagtaataataataatagtagtagtagtaaattattaagtaatgaaaatttattaccttggaaaattaaagtggaagctattaatttattatgtgataaaatgaaatcaaaatataatattaaaaaaacaaattatttatctacattattaaatattattttaaaattattaaaaagtgaatcagccttaccggttgttgtatctacattaaaattgttacatatacttattgaaaagtttgataaagacatttataatactgttaaaaacttctctttcattttatgttctaaattaaaagattccaataaacaagtttctaatgcatgtatggaatgtttaactaaagctatttcggtctataatatcgatttatttcttgatgatctatctaaaaatctaaaagataaaaataataatactaggttagtaaccctagatttcttgttgaagacattccaatatatagataagaagagtatatcctcgctcatagacataacaaaacatttattgaatgatacagtcgctaatataaaaaatactgcttgtaaattatatgcattaattatttcatattatggtgaatccgtggattcctccttttttaattctataccatccaacaaaaaaaagtccatcttatccttatgtgtaaagaatgacaaattgaatgatgcgaatgatgaaaatatttcgaatgatgaaaataatgcgaatgatgaaaataatgtgaatcatataaatcatggatacaatgatgaccatttaaatagtcctaagaatcaatttgaagattctagtgcaaagaaaaaaaaaaatgtagacaatataaataaaatgacaacacttaaaggaaataatatgaagcatacaaaaaataatatttccgatgatgctgaagatataatatctggaggaaagaaaaatataaatactgcacataataataatatgaacaaatcatgtaatatcaataatataaataatgtggaatattatttaccaaaggatatgattaaaaatttaggatcttctaatatccctaat

SEQ ID NO: 139 - DNA, 2526 bp, Plasmodium falciparum
tattatttaccaaaggatatgattaaaaatttaggatcttctaatatccctaataaaatcgaagggttacaaatgttaaatatatggataaagaatgaaaataacattatgatattaaattttgaagatttaattaattttattaaaaagaattgttacgaattcaaaggaaaaaatgttgtattgaataatgcaatatatgacattttttatgaatttatagatatagcatatcaatataatttaaaaaataatacttcattttataaaatgttgaatatacttattagtttatatattgaaaaggttacagataaaaaaggaaatatgttatgtaataattttttacataaatgttttatgtatttcgacaataatataataatagatttatttttaaaaaatatcgattctaagaatacaaagaaatgtgaagaatgtattaaaatattacaaaaaatttttataaacagaaataaaaattccggtgtgaatataaaaaatttaatttattttttaaaaaaatttgtggactctaaaaattcaaatcttaaaaagtcatcaattcttatgttacaaatattatctaagaattttggggacaagtatgtgctttctcatttagaaggaatatctgagaacatcaggcatatggtaaaattaaaagaggacgtagagaagtttgtaagtaagcacgggttaaattactcaacatctatccttttaaaggatatggataggcaacacaatcacataaatgatatggcaacacgtaatattaacattaaccttaacaccaccacagacatgaacaataataataatattaatagtagtaatgttagagattgtgaaacgtttaataaatgcgatattcacgaaggtgatggtaataatatcactattaataatcaaggaaaagatactgaaatagggagacacaaggaaaaagatactgaaatagggagacacaaggaaaaagatactgagacagagagacacagggaaaaagatacattcattaataatacaaatgatatgaataataatataaatcaacaaaataagaaagacgaagaaatgctagatataattattaaaaaaagagatttttctttagaaggtgaagaaaaaacaaataaaaaaggaacagtgaaatcaccaattaataattcttcaaaattgaataatatacaaattgattatacaaataattatttaaattataataatactaatatttctgataatactcctatggatatttctaaaggggtaaataatataaaagaaaataaacatgaaaagaattataaaaatgatgaggtgaaaaattatgcacataacgatgaagaggaagaagatgatgaagaagaaaaaatgattctcataattgatcatataaaaaattatataaatcgtataattagcgataataataataataacaatggaaataacaatggacataacaatggacataatattatttccaacagtgtgtcaaatattataaatgtaatagaaaagattggaaagtattatattaacccagaaaaattggatatattaattaatgataatatattaaacaaaatatataacaacaataagaataaatgcatacaattattatatgttcttatattttctttaaaggaaaatacacatatatatgcagatatattatttgaatttattgtttccataattgatgacattgatatatcagttgaacaaatagataagcttttaacatgtatgtgtcggaatttaggtatttctaaatatattaatcatattaatacatatatattaaatgaaaaattcaataacatgaatgatgactactccaatcaaaataatatgaatagtaatagtaatagttataataattttaatataacagatagaagtaaagaaataaaaaaaaattataaaagaaacaaaattttaatagttattaataatattaatacaaatcatattttattattaaatgaaagtgttataaaaaaaaaaatacttacattttatctagatcttttttttgatgataatgaacaaattagagaaagggcaagtattgttctagataatgtatattccaaatatggacgtaatgtcttttttttcatatatgaaaaattatcagcacataaaaaagaatgcttacaagatatactaaatcaaatgaaattaaataaagatgatttttctttttataaaatttttttatcaaataattcacaacttaaaagaatatcaatgaatgaaagtaatttaagtggaactacaccaaccttatcaaaaacaaaaagtgtaaaaagattaaactcattcactaaaaataaaactatgaatattgatttcccaacaaattataaaattaaaacagataaattaaaatgggacaaacatttagatcacaaccattccaattatttaatgaaagaatttaagtcttttgctactagcgaattaatatcaactatgtttagtgacaaaccacacataattaacagg

SEQ ID NO: 140 - DNA, 591 bp, Plasmodium falciparum
ctatacaactacataatcctcaattatctgtatgacaaaaaagaagacatgctaatattattttgtgaagataccattattcatataaagagtaagaaaaaacattgtgtcataagaaaagaaaatattataaaaattgaaatgtgctgtatttattttaatataacatttgagtgtgataaaaatattatctttaacattaaaaatattataaaaaagaataaaaataatttccttggtctttattttgacatactttttaaaaacaaaaacaaaaaaaggttaataaaaaaaatacagaaaaacctcgtaaaaattttgtacttcctttattatgtatttcattttatatataattataataaaaaaatagaaaacatgaacaaattaaaaaatactaatttatatcataatattaatcatcaacacacaaataaaaaaaaaaatactacttcttacaaatctaaagaacacccatttataacaatatttgtacaaaatcaaaaaacgatattttcgttttcatccataacatatttttatcacttctttattaacataagagatcaattatttaatacacccaattaa

SEQ ID NO: 141 - DNA, 2778 bp, Plasmodium falciparum
acaaacccttatgctattaacaattctgtgtgtagtcaaatatttaattttatacataacatgagaaaagaaataagacaaataaaatatattattcatactattttattttttaaaaataatgatcctatgaaacacatgcttctaaataataacaatttaaatgatatctctatgtgcttatttaattatatacaaaatgaaaatgaaataaataatgtgaataattatgtaaacgagataaacgaatgtgatgataaatataagtacacacaaaatgtttataacaaaaaagtatgtgttcattatatatcaccaataaatgttaaatcatcaaatgatgataatataaatagtttttataataacgagaaaagtgaatgtaattataatgtgtgctttgatgagggaaaacggaaaaatgataataacataagggatgataaaataaatggttacagcaacaataatgataataataatgaacataataacaataatgataataataatgaacataatgatcataataatgaacataataatgaacataataatgaacataataatgaacataagaattataaagaaagtacagataaactcaattttattcatttttataatgattcaaatcaaaaaaaagaaaattattttcataattatacacatgaacaaaacgaccatgaatcatcctcttcacaattttttggtatcccaaaaaatcaaacatcaatatatttttataaaaaagaaaaaaaaatgataaattttaaagaattcatgaaaaattatgaagtcaagaatattatgattttctttatctgttgtatattttatttaaatgaattgtacataaaatataataattcgctagtcacaaatattaaacctattgatgataatacaaaaagggatattcatcaaggagaagaaaggactgaaatttattattgcaagagtgataagataaatatgaatcaggtggataattcaaacaatacaaattgtaaagatgaagaacaatcaaacaatacaaattgtcaagatgccgaacaatcaaacattacaaattgtaaagatgccgaacaatcaaacattacaaattgtcaagatgccgaacaatcaaacattacaaattgtaaagatgccgaacaatcaaacattacaaattgtcaagatgccgaacaatcaaacattacaaattgtaaagatgccgaacaatcaaacaatacaaatagtagccacatgaaccatttaaaccatgaggtggttataccaaatgacaaactatatatgaatacatacacaaacaatattaacccttttgatgtatcaatttttaaagaggctgaaataatgattgaggaataccgtacatgtcttcatgagaacaaaaggatgaatatacttcatgatattctatgcaatattatattatgtataaaaaataattatgataatatacataatgtatttttattatttaatgatgatataacaaaaagtgatatattaaatataaaatatatttataagttaatagacaattattcaaaaatagattcatatataaaacatataaacaatagttgtaatgaaaaaataagaaatacagaaaataactttaaagaaataatttcgaacaaagaagatttgataaatatttataaagaaaatataaaaaataaaatacaattaattgaagagaaagatttaattattaaagacttaaaattagaaatacatattttattaaaagataaagaaattacaaataatttattaaatgaacttacagaggaaaaaaatacatattttaatatgtatatgaaatatcatcacgaatggatacttaacaagaaagaaataataatgaaagatgataaggacgaatatacttatacaacaaatgatgagcataataatcataagaaaataaataattgtattaaccaaattaacaaattaaatgatgaaatcatattattaaaaaataaaaataaaaccttgttacataaaagagatactaataaaaatacatcatcttctgtgtgttcacatatgtcatcaccatcaccatcacgtatttcatcaaatagcatttttcattttaaacaaacagataatcaaaatgttgaaaatgcagatccaaatattattatagataataataattcaaatacaaaagaaaaaaaaaaaaattctttaacaaatcttattttaaaagataaaaatgataagttaaaaaatttccatattaaggaaaatattacatctacaattcatatgaaaaaaatttataaaattttatttcttttaaaagaaaaaattattctttttattttctatatatataaaaagatttataaaaatgcttacattaatatttcatatattaaacaattttatacacaaattataaatatttttattaatatccccagatatatttgttcttcttatatatttgttaaagaaaatgaaataaattataatatgtatattaaaaataataaaaataataaaatatatttacacacaaatcatagccacattttacagcttactgatgataatacttcattaaataaacaaaaaataaatgaaaaaaaaaaaaaaaatcaaaatattaaaataaaaaaatattctcataataaaagaaatctatataatcataattttctagaaaatacatcaattcaatcatccacatctccccaaaaaaaaaaaaaaaataataatttacaacgggctataggaaaactctccgatgag

SEQ ID NO: 142 - DNA, 1704 bp, Plasmodium falciparum
atggaaattaaaacaatagtacagaactcatataattccttttctgatattaataagaacattaatgatattgataaagaaatgaaaacactgatccctatgcttgatgaattattaaatgaaggacataatattgatatatcattatataattttataattagaaatattcagattaaaataggtaatgatataaaaaatataagagaacaggaaaatgatactaatatatgttttgagtatattcaaaataattataattttataaagagtgatataagtatcttcaataaatatgatgatcatataaaagtagataattatatatctaataatattgatgttgtcaataaacataatagtttattaagtgaacatgttataaatgctacaaatattatagagaatattatgacaagtattgtcgaaataaatgaagatacagaaatgaattctttagaagagacacaagacaaattattagaactatatgaaaattttaagaaagaaaaaaatattataaataataattataaaatagtacattttaataaattaaaagaaatagaaaatagtttagagacatataattcaatatcaacaaactttaataaaataaatgaaacacaaaatatagatattttaaaaaatgaatttaataatatcaaaacaaaaattaatgataaagtaaaagaattagttcatgttgatagtacattaacacttgaatcaattcaaacgtttaataatttatatggtgacttgatgtctaatatacaagatgtatataaatatgaagatattaataatgttgaattgaaaaaggtgaaattatatatagaaaatattacaaatttattaggaagaataaacacattcataaaggagttagacaaatatcaggatgaaaataatggtatagataagtatatagaaatcaataaggaaaataatagttatataataaaattgaaagaaaaagccaataatctaaaggaaaatttctcaaaattattacaaaatataaaaagaaatgaaactgaattatataatataaataacataaaggatgatattatgaatacggggaaatctgtaaataatataaaacaaaaattttctagtaatttgccactaaaagaaaaattatttcaaatggaagagatgttacttaatataaataatattatgaatgaaacgaaaagaatatcaaacacggatgcatatactaatataactctccaggatattgaaaataataaaaataaagaaaataataatatgaatattgaaacaattgataaattaatagatcatataaaaatacataatgaaaaaatacaagcagaaatattaataattgatgatgccaaaagaaaagtaaaggaaataacagataatattaacaaggcttttaatgaaattacagaaaattataataatgaaaataatggggtaattaaatctgcaaaaaatattgtcgataaagctacttatttaaataatgaattagataaatttttattgaaattgaatgaattattaagtcataataataatgatataaaggatcttggtgatgaaaaattaatattaaaagaagaagaagaaagaaaagaaagagaaagattggaaaaagcgaaacaagaagaagaaagaaaagagagagaaagaatagaaaaagaaaaacaagagaaagaaaga

SEQ ID NO: 143 - DNA, 1698 bp, Plasmodium falciparum
gaagaaagaaaagagagagaaagaatagaaaaagaaaaacaagagaaagaaagactggaaagagagaaacaagaacaactaaaaaaagaagcattaaaaaaacaagagcaagaaagacaagaacaacaacaaaaagaagaagcattaaaaagacaagaacaagaacgactacaaaaagaagaagaattaaaaagacaagagcaagaaaggctggaaagagagaaacaagaacaactacaaaaagaagaagaattaagaaaaaaagagcaggaaaaacaacaacaaagaaatatccaagaattagaagagcaaaaaaagcctgaaataataaatgaagcattggtaaagggggataaaatactagaaggaagtgatcagagaaatatggaattaagcaaacctaacgttagtatggataatactaataatagtccaattagtaacagtgaaattacagaaagcgatgatattgataacagtgaaaatatacatactagtcatatgagtgacatcgaaagtacacaaactagtcatagaagtaacacccatgggcaacaaatcagtgatattgttgaagatcaaattacacatcctagtaatattggaggagaaaaaattactcataatgatgaaatttcaatcactggtgaaagaaataacattagcgatgttaatgattatagtgaaagtagcaacatatttgaaaatggtgacagtactataaataccagtacaagaaacacgtctagtacacatgatgaatcccatataagtcctatcagcaatgcgtatgatcatgttgtttcagataataaaaaaagtatggatgaaaacataaaagataaattaaagatagatgaaagtataactacagatgaacaaataagattagatgataattctaatattgttagaattgatagtactgaccaacgtgatgctagtagtcatggtagtagtaatagggatgatgatgaaataagtcatgttggtagcgacattcatatggatagtgttgatattcatgatagtattgacactgatgaaaatgctgatcacagacataatgttaactctgttgatagtcttagttctagtgattacactgatacacagaaagactttagtagtattattaaagatgggggaaataaagaaggacatgctgagaatgaatctaaagaatatgaatcccaaacagaacaaacacatgaagaaggaattatgaatccaaataaatattcaattagtgaagttgatggtattaaattaaatgaagaagctaaacataaaattacagaaaaactggtagatatctatccttctacatatagaacacttgatgaacctatggaaacacatggtccaaatgaaaaatttcatatgtttggtagtccatatgtaacagaagaagattacacggaaaaacatgattatgataagcatgaagatttcaataatgaaaggtattcaaaccataacaaaatggatgatttcgtatataatgctggaggagttgtttgttgtgtattattttttgcaagtattactttcttttctatggacagatcaaataaggatgaatgcgattttgatatgtgtgaagaagtaaataataatgatcacttatcgaattatgctgataaagaagaaattattgaaattgtgtttgatgaaaatgaagaaaaatatttttaa

SEQ ID NO: 144 - DNA, 1053 bp, Plasmodium falciparum
ggatctcttacagggaaagtttgtttatacaaaataacgattaaagaaaataaagaaacaaatacaaacatatcttatgtttataataataataataatattacagatgatgagaaaaaatgtataaacgatttaaataatagagaggaattaaagaaagaaaactatagcaaatcaactatagatgatgtggttataagtaaaaaggaactaaataatcacaataatataaataataataataacaataataataataataataataatagtgagataattaaaaagtatcatattttatgtatgtttagaaataatagtataaaatcaatatatattgacaagaataatatatatatatgttatgaaagttgtattgatgttttttgtgtaagatcatatcagtttattcaaaagattaatttagatgtaacaaataataaacaagtaatatattatgagaactatatattatttaataactcaaaaagtttatttatatatgatataacaagtaatttttctagttatttttacaaaaatttcttaaaaaatatagtcatttttgattttaatataaattatttattatgttataaaaataattttgggaaatgtcatattcgtgtcctacaaatttttgctgatgctcaaaaatgtgaacatgagttaattttttgtgtagacttttcctctaaatttataagtcatggtaaatttctagatgatgaaaaaattatagttgcaaaaaatggtaaaagattaatcatatttgattttaaaaaagctatagatatgtatcgaatcagaaaactaaaaaaaaaaatattagacatacacaaatccgtagaaaatatgttatttatattagtagaaaatcaaatttttattttcaatttatctacatttgtattctataaaaccgtacaattacctaagggccttttttattttaagtggtcctatttcataagatataaaaaccgaaaaattattttttcatcagacaagggagtatattatatagattattccattgaagaaaatgtttaa

SEQ ID NO: 145 - DNA, 2832 bp, Plasmodium falciparum
atgaatgaaaataatagcaaaaatgttgttgtggataagcctattaaaaatgctgaagaagaaaagaaaaaggttgaagatataaatagtttatatgatatattgaaaaatgtgagtaataataatgatatttttaataatgatgattatattttaaaagaattatatcctttaataaaaaatgttataggagataataaaaatatttgttaccattataataaatcatttatgttaaaaagatggtgtttaaaaattttatatacattaataaataaaattaaggatatgaatttgtttcttgatatttttaatatgtgttcaaaactaattataagggagaatgagatgaattgtctgagttgtattaaaataatcaatgtaatccttgaagaaaataaaaataatttgaacatgtttgacgtagatacttatataaatgtgatatgtctatctattttgaaaaatttttataagaaaataatatataaggtaaaaaagggaaaattcctcaagtcttcaattagtatatatatgaaaaaaaaaaaaaaaaaaaaaaaaattgaaaaaaaagtaaaagtaaaggaaaaagaatataagaatattatttatttgcaaaaaaaaaaaaaagagagatatattttaaacagtacagattctatcaaagtaatcaaagaaatcgtattatctgttctttttataatacgtatatatccgaatgttataaataatgttgggaagtacttaaatatattatgtaaaatattatctataattaatatgtacgattttaaattagaatcttccttttttattgagacaattgtcgaagcgaataattattattcaaataataaaaatgatacaaatcaaaagaatgataagtccaatatgcatattattaaaaatgttttttattatcaatatataaataaatctgaaaacacagagcataaaaaagaatgtaagactaaccatttaataaatgtaccttccaaaatagacaagaataaatgttctcttttgttatgtaataataaaagtgatgagtttgataacaatggtaaccttcatcttatgtttaatgaaatatgtcatgatatggataagaacaaaatgtatgatggtttcccctttgatcataatcataatgcagctttggtaaataaattagaatgttttaataaaagtacaaatgattgtatttgtttggagttggagggtattcatagacaagaacttaatgagaaacaaaaaaaaaaaaacaaaaaaaacaaaaaaaaaaaaaatgaagacattaaaggggatgtaaaatatgatgttaaaggggatgtaaaagatgatgtaaaagatgatgtaaaagatgatgtaaaaggtgatataaaatataatgttaaaggtgatgtaaaagatgatgtaaaatacaatgttaaccatgtagacaattttgttaatgaccagacgaacaatagttcttatgttaataaattattatataataataattgcttgtattatgagaaatataaatggtatgatataaagaatgttattaatataaaatgttgtgaaaagaaaaaattttgtaaacatgttaattataacatgtatgaacttgatagaaataaacatatggacttattaactttacaaaatggtattatttatatgatttgttatttattaagagaagataaaaaaaataaattttgtcattataaagagtttgtaataaagaaagttatatatatgttaattaataatcaacatgattatattgaaaaaaaaaaagaatttattgaaaatatccgtatgtttttacataatagtttcgatgaacaaatgaaatattacatttcattttttttaaatccgtttttatataataaaaggaattatatatatataaataagcaaagcttattaaatatatatatattttctttaatccatgatatgttattatattataaaagtaagaatgtttggaattatgatacaattaatttatgtataagtaattttgtcgatgtacttatgcataaacaagcatatatatatattcaaaatgtttgtataaatatgtttgtatatataattaatatattatttatgattaagaagagaaatggaaccttcttttcattatatttttttattttgaatatcctgatgaataaatgtgaatctttaaaggaagaaatttataacaagatatataagcgcatacaaaggttaagaagaatatcaaataatagtaaggggcaggagaaaagaaagaataagataaaggaaaaagaaaatactgaattttataccgataataaaaaaaagatgatatgtaataattattatagtgattgtacatatgatacaaatcgttttgtaaaaagaagtataataaaaaatgtaaatatatataaaaggagtagtattattagtagtaatagtatttgtaatagtatttgtagtaatattaactatttatcgcttagtcgtgataaaaaatgtagtcattcaaaaaatgctttaaatttaaaaaataataaaggatataggaagactaataataatttgtatattattaaaaagagaaattaccataaaatgtatcatatacttatagcatataaatatattttatatgctcttcaggtgtgtataaaatataatatatattatatatatatatattttaatcaagatattataaataataatagctcgaatgtgttaatacaacaaggagatgatataaaaacatattttttaagaaatgatgatataactaaagacgataaaattactcagaaacaaaatcattctattcat

SEQ ID NO: 146 - DNA, 2544 bp, Plasmodium falciparum
ttaaaatgtttctcttttccaagaaaaggaactaacgataagacgaaggaaaatgaaacatttgaaaaaggagaagtaaaagaagaagaagaagaaaaagataaaaacgtcaaaaggaaaattattaatgaaagtagtaaaaataaaagagctaaagttaagaatgaaaatgatgttataaaaaaagggtcgttatttaattgtgttgtaagagaagatgaaaaagtgaatgatttgagctcacctaaatttaatcctgtacattttaatataaatgatttatatttatctgaaaaagataaagaaaaacataaatttaaagactccttattatttacctttttaacaaatgcatttaatcaaatagaagaattaaaaggtagtggtacaggaagtaaaaaaaatgtatctattatattatcgaatatatttagggttttaatatattatagccctaatgacttaataccagctgtatatataaccttaaataaagtagctcccgattatttaaatgtcgaagctggtgtaggtgaagccttgatattaaaaacgatgtctgaagcatatagtagaacggaaagtagtataaagaaggatttacaacaaattgaagatttaggaataatagcggagaattgttcttgtaaaatgagaacaatatttccgttacctcgcttaactatacaatctgtttttcatgagctaaaaagtatacctaaccttataggatcaaattcacaacagaagaaaagggaagtcataaagaaattgttagtaagtgctaaaacatctgaagctaaatatattgtaagatttttacaacagcgtttaaggataggtgtaaattctgcaacggtcgtacaagctttgtcatatgcctttatattaacaagacctagtatacctgatgatattataaaaagagggaaagaaattaatgagaatttgattaatggtaaattggatggtactaataatttaattaataaatctaataacaagacggaagagtggctaacccaatcaggtgataggaattgtataaaggaagaaaatttaaatgatgaattattatcaaaggatgatataaataaatgtgaaaacatggattcattaattaatgagatacgtattcgaaatgaaaaaataaacaaaccgaatattttttataaccttattgaaaaggtgggtgacacacgattattaccattattttttaaagaattaaaaaatatatattgtgaagaaaataatgatattgatatatttgaatgtatggaaaaatcagttaagagtgctttatgtgaattacccaatatcgaaataataatacaaaatttattaaatggtgatgatatgaataccttaagtaaaaaatgtactgttaaaacaggtattcccgttcaacctatgttagcaaaaccaactaagggtgttcaagaagtgttggatagatttaataatgttacatttacttgtgaatataaatatgatggtgaacgagcacaaatacattatatagataaagataatataaaaatattcagtcgaaatttagaaacgatgactgaaaaatatccagatgttatacaaataataaaggatcaaataggagagaatgtaaaggaatgtattatagatagtgaagttgttgcttatgatatagttaataataaaatattaccattccaagtcttaactactagaaaaagaaaagatgtagatatagaaaatattaaagtgaaagtatgtctttttccatttgatttaatatgttgtaatggtataccagtaattaaagaacctttagctgttagaaggaaattattatattctttattaaagtcaaaagatggggtgttatcatatgctacccattctgaaatgaataatattgaagatattgatatgttcttacaagatgctatcgaaaataattgtgaaggtttaatggttaagactttagtagaaaatgcatcctatgaaccttctaggagatcattaaattggttaaaggtcaagaaagattatgttgaaggtctttcagattcggttgatttagttccgatagctggttattatgggaaaggaaaaagaagtggagtatatggagcttttgttttagcagcttataattctgaaacggaaaattttcaaaccgtttgtaaggcaggtacaggttttagtgatgagatattaagtacattatatgaaacattaagtgaaaaaattataccaaataaaaaatcgtattacgaagtatctgacaaattaaatcctgatgtgtggtttgatgctcactatgtatgggaggttaaggcagcagatttatctttgtcacctgtacatacagcagctattggtatatatgcagatgataaaggtattggtttaaggtttcctcgatttttacgtttaagagaagataaaaatgcagaacaagcaaccactacacaacaaattgtagatttttatgaggcacaatttagtagtaataaaaataaaaatattgattataatgatgatactgaaagtgaataa

SEQ ID NO: 147 - DNA, 582 bp, Plasmodium falciparum
gaattattaaccaaggcggttaacgaaaatggagagaaacctgacgaagaagtgaaatccgtcttgtacgacaatgtagacaaaaaatacccagatgtaaaactagctctttgtcgtattagaaatagcttaaaaaaaggtagtgatcatagcacgggaagtgtatttattgtaacatttaaaaaaaactttccacacaagaaagagaaaaatatgggtatggtatatgttgtaggaccaaaaggaaagaattacaattcagtggaagaatttttagatgaagttcaagaaacagcagaaaatttaatgacaactctttgtgattataacggtttagttaaaagagaagaaattaagcatgtaagaatgaacacatgtagaatctgtttattctcaggtagtatctttaaacatcctaatgcctctaaattagatgtagctaaagctatattaaatggattagctgttggatatagacatggaccatcaccaagattaaattttgcttatgacgaaaatgtatttaaagacgcatgggtagaaaccactggattacaagttttcaatcacaatgagcaataa

SEQ ID NO: 148 - DNA, 2580 bp, Plasmodium falciparum
atgtatccactatactatgagaaaaaaatcgtaaagaaattgatagaacaagattccttaataatattagcagatggatttaatgaactaaacattttagcaatttttatattttattatcaaaacaggtgtttatgggatgaacaatatataaataacgataacatattttttgatttattcaatttgaataaatataataaaacatatgacaacggacatataaaagtggtacaggatgatggacaagaaaaaaatatacaaaatgaaagtaccacaaaatatacgttaaataaaaataaaatacaaaatgataatgaagtggaatattatatagacgactcggataattctgatgaatctaaaaaatatgacaagtctaaaaaatatgacaagtctaaaaaatatgacaaattcgatgttaccacctgtcgaaaaaacataatagataacctttttgataactatacatataaggaaccaaataatgaatttccaaaaaataacaatgaaattatattattagaccatcctgaggaaaaagaaaaaacggagataaaggaaaatgacattgatattaataagaagaatgataattgtaataatatgtgtaatattaacaaatcacaaaacaatcatttaaaagatatgtgcacccaaaataaactgatttttatattaaacgtcactcctaaagaatacaatatttttttgaaatatcaattatccttatatgaacaaattaatgaaatagatgaaagatataatgataaaataaaaataaattatttcaaaactgaatatataagagatcaaaaatcacacgaaagaatagagatgtatataaagagaggtgtgtacttcatttcttctaatgtgctactaatagatttattaacatttaaaataattcctgaaattattgatggaatatttatttgtaaaaatcatagattgatatataatatgaaagaaatatttattatcgagttatataggaaaagaaataaatttggttttattaaaggaataagtaataataaaaaattaataaatcatcaacatattgttaatttagctcagaaattatttatgaaaagaatttattgttatccaagatttcataaacacatacatatatcgttaaataataaatttttacaaccacacatatatgaaattaatcttgatattccaaatgttcttttaaaaatagaagaaaatatacttaatattttacattaccttaatctagaaataaaaaaaaattataattttcatgattttgatttaaaccctttattatattctgaaaatgcagaagcatatgtacttaactatattaagacaaaaacacttaattataatactaaaaagttattaaaagaaattattacattagttaatatgttatgtaatttgtttatatatgattcacttatattttataattatcttaataatttaaaagaagcagataaggaatgtatttggttatattgtaatgaggctaacgaaattttttatttatcaagagaaagaaataaccaatttttaaatcaaatggatatattagtcaatcaaaatgatataaataatacacaaaatattattaatgtcatacagtatgataataattattttcataaatcatatcaagttaaaaaagaatctaatcaattatataattgggtatatgaattagtttataatagagatattgaaaaaaaccagtatgaaaagataattgaacagaaagaaagaatcaaaaataaaaatctcatgaaaaaaaaatttatattaaataaaaaaaaacataacgaatcaaataaaaaacctctgaaccataacaaacatacagaagacagaacatctattatattaaacaataacataaatataaaacattcaaaaaatggtaatagtaatagtaatactacagaaaataacaataaacgaaggaaaataataaaattacaaaaatttaatgataataatagtaataatgaaaatatgtataatttaataaaaaaagaaaaggatcatattatacaaataaaatcttcagatactgaagataattctgttaataacaaaaatggtattattaaatctgatgaacatatagttattaatgatcacaaagaatgtaaataccagatggataaaataaaccttgatcaaagaaatgataataacattatgcatatgtataaaaatcaaacaaaaataaataaatcaatggataagatagaatatccaatagtaataatagttgacaatttttatatgcaaaaagaattttataatttgcttcttcacacaaatgatgataaagttaaaaatacggatagcataactaacccaaacaataatcataataataacaatagtggtgacaataattttgagtgtgacaaacatttaaatatacttattaaagacgaaaaagaaaataaaattactgacaattatattaccgacgattctgttagttctcaagaaagttttaataataataataataataataatgtcaacatgtcaaataatgcaaaccttttcaatctacaaaataat

SEQ ID NO: 149 - DNA, 2142 bp, Plasmodium falciparum
atacatacagatttgttattaaattttttaatttatatatattataaatatttttattataattcacacgctattgatcacaactttacacattttattcatttatttttgagtattcatgaagaatcatataataatagtcttattatgattgaaggtaataaaacaaaggaaaataatatagatcacacaaatcagaaggatatatttgtaagaaatttatttatgtctcttgataaatgtaactataacaaattagggaataatagaaaaaatatgaagaatattacaaatgatgatactcttttaagaaacaatataaataatattacaaatgatgatactcttttaagaaacaatataaataatattacaaatgatgatactcttttaagaaacaatataaataatattacaaatgatgatactcttttaagaaacgatgttcttaaaaaaaatgaaataattgatgataaaaaaggtatgagtataaaacaatatagcattaaacataaatcattttataacgaggaagattatatgagaaatgatgataataataataataataataatattatatataaagatgcaaataattactatttagtattattaaattctcaaaatagatatatacaaatactattttataaagtgttatgtaattttataaaatgtaaagtacaaacattaaatgctaagaatttatttaagaacgtaaacttttatttatcatcttttgtaacatattcatttcttaatacatataatgaagacaacaatttttattacaaggctttaaattataaatactccttttatgattttagtacacttaagaaaaacattaagttgtgtatatatttgaaaaatttatatttaaagcatgatatgtttaatagtgatatattaaattttctgcatattgagggatataaaaatagaaaactgaggaaagctaaaacgaaaattaaaacgaaaattaaaacaaaagaaaaaatgaatgaaaaaataaaaatgggcaagttttattctagtgataatataaaatatgatcaaaatgggtgtaacaaatatgagggggaaaatgatgtatcacataataacgttttagagaatcacaagaatagtagtagaaatatatatggatatacaaatacttatccaaatacatatgttcaacgtgattaccataatgtgaaagaaactcatgatgtgttatataaaaataatgagaaattaaattataaacgttcttttgttgaagatgatgcgataaataatacagcggtagttattaagaaatacaaactgaataatattgataatgctcatgatagctataatgataatgtaaatatctcagaagggtccgtaagtgttgaagaagaaagagataatagaaaaacaagaaaggattatggtaattattctgatgataaagaaggatgtaatattaattgtaatatttatgatatgaataatcaatatggaagaataaaaatcgaaatggaacattctaatgattgttataatgaaagaaataattatccaatgaatcatgcatgtcatgtagaaagatgtaatatggaatataaagaagaaagtaataatataaaaaacacaaaatatgtttttgataatacaaattgtatgaatataaaaaaagaaatttatacggatgaagatacaattgattctatagattcattaaaacaagcagaaatatttaagaacaaattttataaaaatcgcaaaataaaaagagtttctaagaaatattatattaacattttaaattatcatttaaaaaataaggtgcatggttattcaattaaatctttggatagtttaaaattggatgataagtctatatatttaatatttttatttctagggaatatttttactgtattatataattctttattaccctattgtggttcacagcataaatataaaatgataaatgatataaaaagcaaaatggagaaaaaggaaaaagacaaaattgtagtgaatataaacgaaaatatgtcaagtgattatgcatataaaataacaacagatagtaatagtagtagtaacaataataataataataataataatagtggtggtaggtttagtagtacgaag

SEQ ID NO: 150 - DNA, 1659 bp, Plasmodium falciparum
atgaaattaacaaaaggctgtgcctataaatatattattttcacagtgttaattttagcgaatattctttatgataataaaaaaaggtgcatgattaaaaaaaatttacgtattagttcgtgcggtataataagtcgcttgctcaaatctaattcaaattataatagttttaataagaattataatttcacgtctgctatatcagaattacaattttccaatttttggaatttagatattttacaaaaggatatatttagtaatatacataataacaaaaacaagcctcaatcatatataatacataaaagactaatgagtgagaaaggagataataataataataatcaccaaaataataatgggaatgacaataagaaaagattaggatctgttgtaaataatgaagaaaatacttgttcagataaaagaatgaaaccttttgaagaaggtcatggaattacacaagttgataagatgaataacaacagtgatcatttacaacaaaatggtgttatgaatttgaatagtaataatgttgaaaataataataataacaattctgttgttgttaaaaagaacgaaccaaaaatacattataggaaagattataaaccaagtggatttataattaataatgtaacattaaatattaatatccatgacaatgaaactattgtaagatctgtacttgatatggatattagtaaacacaatgttggtgaagatttagtttttgatggtgttggattaaaaattaatgagataagtattaataataagaaattagttgaaggagaagaatatacctacgataatgaattcttaactatattttcaaaatttgtaccaaaatctaaatttgctttttcatcagaagttattatacatccagaaacaaattatgctcttacaggtttatataaatcaaaaaatattattgtttctcaatgtgaagctaccggattccgtcgtatcactttttttattgacagaccagatatgatggcaaaatatgacgttacagtaactgctgataaagaaaaatatcctgttttattaagtaatggtgataaggtgaatgaatttgaaataccaggtggtcgtcatggagctagatttaatgatccccatttaaaaccatgttatttatttgctgttgtagctggtgaccttaaacatttaagtgctacatatattactaaatataccaaaaaaaaagttgaattatatgtatttagtgaggaaaaatatgtatctaaattacaatgggctttagaatgtcttaaaaaatcgatggcatttgatgaagattattttggattggaatatgatttgtctcgtttaaatttagttgctgtttctgactttaatgttggtgctatggaaaataaaggattaaatatatttaatgctaattctttattagcatccaaaaaaaattcaattgatttttcatatgcaagaattctaacggtcgtaggacatgaatatttccataattatacaggaaatagagttactcttagagattggtttcagttaacattaaaagaaggtctaacagtacatagagaaaatttgttttcagaagaaatgacgaagaccgtaactactcgtttatctcatgtagatttattaagaagtgttcaattttta

SEQ ID NO: 151 - DNA, 2346 bp, Plasmodium falciparum
tcgattataaattctattaatagagataaattaaaacattccaaaccattatataagaacaatataaaaacgaatgatgataataaaaaattaagggaaaataaaacgaaaaacaaaagattagtttcaaattatttaggtaatttattttatataaatgaaaataatgaagttataccattaaatataaatattaaagatgttgtaaataattccccatttaaatcccctctgtttcctaacatggtatttattggttcacgagaatctactattattaatttagattatgacacaggacatgtactaagaaaatatgatgaagcatctaatgaattgttagacaaacccccaaaaaaaaaatcaagaaaaaataaaagtataaaaaatgtgaaagatataaatgataatatgaagttatataaagaaggtagtcaaaatgtagaggagttatcctttaccgaggaggagaataaaaagaaaagtattttagagggtgagaaaatagaagtggcgtccttaaataatgaagagaatatgaataaaggttttgtgtgtgaaaaggatgataaaataaataattatgataatgatgaagatgatctattctatgaacaatatgaagacaacaatgataatgataataataaaaatgataataataaaaatgataataataaaaatgataataataaaaatgataataataataataataataataataataataatagctattattattataatattaatggtaatgctagtgatgatatattagtacattcaaaaaatgaattattaaataatacgtatataaataaaacaaatataaaagatgaaaactcaaataataatgaatcatttctcaataaaattgatgggatgaataattttaaattgctaccaaaaagaaatatgaaaagaaatagaaaaaagaatctccttaagagacttatggtaagtacaaataaactgagcatgttattgaatagatatcatttaattaatcgtagtttagaaagaatgagaaaagatattaaaagagggaaaaataaaagaatattaaaaaaacgtcaattacaaataagtttaataaaatgggtaatcaaagcagtagatgagaatacattaaaaaagaaatggataacaacttgggttgatgttggatctatatttatgacagatgttcataggaaagatacatcatttataaattccttaattgaaattgttggaaataaattaatattaagaccaatagaaaaggacaaaatgaaaagtactacatatcaaattttaaagattatgaataatgacactgatgaaatacaaatgtatcgaaatgaagatatgaaatatgaagttattaataatgtggatgatataaataatgtggataatataaataatgcgaataatatgaacaatgtgaataatataaacaatatgaacaatatgaacaatatgaacaatatgaacaatatgaacaatatgaacaatataaacaatatgaacaatataaacaatatgaacaatataaacaatataaacaatataaacaatatgaataacattctaaatgataggttaaaaaatcgaattaataataaagataattccaacataaaatcgaaaatatttattttttcagaatccatatcatccgtttttgcagtaaaatataaaaatttatcaaatatatttacgttagatattatagcaaaaccaaatataaaattatattctgattatgataatttgaataattttacatataatcctgtacatgtaaaaaaagagagaacactttttttgccgttttctaaggatatatctgatttagatggagataagttttcatgtagttttgaagataatataatatatggtaaaagattaatacatcgcttaaatagtatatcagtaaatatttcttctatagaaaaagatatgaaatatttattatcaaatattatatatgtatatgacaagaataagaggattccaataagttatatatatgatatgaagaatttaatatatgaatatcaaaaggttaagcaagagtttttatatcatttaccttgggatgaaggagaccagaaatatttaagtcgaacggatgatgtattaaataatagtataatagataatataggtaaaaagggtccaatttttatttgtgaatatataaacaaatttatggatttatactttgaagagaatgatatttgttatgattattgttctatgttaaatatatgggataaaatttttaataatactgttagtgatggagattctttattattgtcaaatttgtatcgtgttgtacataat

SEQ ID NO: 152 - DNA, 2196 bp, Plasmodium falciparum
tttaaaaaagatgttctaatacaattaaaaaagaataatttccaaacatataatgatgtattatataaacaattgcaacatgtcattttttggttagatgattggtcatgtagtagatcctatggattaggaacttatatgccacaatttgatcaaaataatcaaacgaataaaaatgttgataattatcaaaataataatgagtatgtaataccatccaatgatgataataaccaaataaacaatcaccatatcaatgttgtgaaggaggaagaagaaaagaatgtacatataaaaaacaattcacgaaaagaattaatagagagtctatccgattcaactatatatatggcgtattatacggtgagtcattttttacaaggaagtgttgatggtcagaaaagaggtttattagatattagcgcagatgatttgaatgatgctttttttgattatatttttgatattagtgatgatacaagtaatatatctaaacatatatctaaggagaaattagtaagaatgaggagagaatttacctactggtatccttttgatgtacgtatatctggtaaagatttaatttttaatcatttaacaatggctttatttaatcatgttgctatatgggggaaaaaagaaaaatatgatcgaaataaggaagatgtggaagaaagaagtattttagatagacaaacagaaatattaaatgagttagaaaatattgatttatcaagttatgagaaaataaaatatttcccacgttcttttttttgtaatggacatgttttagtgaataaagaaaaaatgtctaagagtaaaggtaattttataaccttagaagaaagtatagctttatatactagtgatgggaccagaattgccttagcagatgcaggagattctatagaagattctaattttaatactgatacggcaaatagtgctattatgaagttatataatttgataaatttttctatagaaacaaagaataatgtatatatatttagatgtggtgagaaaacatttaatgatttgatatttgaaaatgaaataaattatttaacaaataaatgtaaagaatcctatgaaaaattattatttcgagatgttttgaaatatggtttttatgatatgttattaaaaagagatacctatagaatgatgtgtgataaaatacatatgcataaagaaacagtaaattttttcatagaaagaatctgtataattattaatcctattattccacatgtaaccgaacatatatggacttatattcttaagaaagatacatttttaattaaacaaaaatggccatcacctgaagaaaccaattattctatagttatgcataagcaaaataataatctattgaatgttgtcgaaatatttagaaaatcatatgataaggtaatcaataaatgtaacaagcaaaaggttgtgaaagataaaaatgtttcaaaggaaaacaagaatcacaaagatcttataaacaagataaataatgatgaacagaataaaaagaataatgatacaaatgtagagacacaaaatgattcttctgttcatattgaaaaagaaaacaataatgataatctgaagaagaacatacaacaaataaaacaaataaaccacattagcaacaataataataataaagataatatttgtgatgggcataataacgatatagatgaagatgatgatgaagaaagagatgatgaagaaggtgcaaattattataaagaagatgaagaagaaaagatgaagtttaaagcaatcgtttatgtagcaagggaatataatgatactcaaaagaaaattatagaaatattaaataatattattaataatagtgaagataaaaaattaccaacgaattatataaatctattagtccaaaatacatatgttaataatttaccaaaaaatgaaaaaaaagatatactcagttttgcaacttttctagtaaaagataatgttactttaaataataatcaatatgaattatcattaccctatgatgaaatacaactaattaaggataatgtagatttcataaaaagaagtcttaatttgggagatatacaagtattagaaaataataaaaaaagtgaaattgataatactgatatatataaaatgtctaatccgggatatccatccatatatatatacaacactgaaggataa

SEQ ID NO: 153 - DNA, 1938 bp, Plasmodium falciparum
attgatgatgaaggtatagagaatttaatcttattaaggtcatcgttttttaccatcctagtatgttatttaagaaataatttaataaagatgaataaaatatataccaaaacaaaagaatcgaaaaagttaaataaacatttcaataattatttagaagaaattgatgatgttttatatttttttgaagatatgcttaattgcgaaaaaaaaagaatcaatgatatgttaatagtaaagcttattatttatttttattttccaataattggttcttttcataacgccatatattttcatggagttcatcctgaaagcgatagtaacatttgtaatcatgcggagaaacgagaagaacaaaatatgttcaagaaggatattaatagtaatgatataaacgaggagcaacttaattatggtagtcttgattatgtatatttttcaagcaatggaaaagatggtacttcaaaagaagttcatatgaatcatgcaaaaaaaaatgacacaaataatgtgaataaacaaaatgaagaggacaaaaataatttggaagataaaaatgatttggaagataaaaatgatttggaagataaaaatgatatggaagataaaaataatatggaagataaaaatgatatggaagataaaaataatatggaagataaaaatgatatggaagataaaaatgatatggaaaataaaaataatttggatggtaaaaacaaattggatgataaaaaaaaagatcaaaaacaaaaaaatatgtataagaatgaaaaagttccaacagattcacataacgaaaaaaaaaagaaagaagttgctttcaaattaaacgaacaaaatgataatgatatgatggattatcaaaataataaaaattcaaaagatgatgatagtaataatattaataataaagacgaaaaagataaaaatgatataatttatactaatcctgaaatatctttagagaaaattcaactgttcaattcatataatattccctttttacgattagttgataataattttagaaattgtaaaaattatgatttctgtaaaagtttatcttcatcaaatgaatcttctatgaattctaacataagctacattgaaagagagaaggatgaagatttgttttttaatgaagaaaatataacgaaaactgaacctttaataaatgaagatgataatactataaataaaaatgactctaacaaaaagaatgaaagtaataacaaaaaaaaagagaaaaaaagtgaaaatgcttatgaatttttgtactttaaaggaagattaaatgttaggagacaaaaggatactgataaaaataaaacagaagcaaataaaaaaaaggtcgacaatgaaacaaacactgtaaaaaataataatatgattgatcaatataatagtgattctaattttataaaagaaaatgatttaaaagattattattttaaaaaaagagaaaaaaaaaatatattcattcaattaaattcacgaaatggaatattacataaaaaaaaaaaaataaataataataataataataataataataatacacaattgaacaataattcctttaataataatgaagaattttgtgatataaataattttataaataataaagaatttttaaaagatattaaacaaaataatttatatgattcatgttatgtagaaataccaaccctccaaaaaaaaattacttttgatgaaaatattaataatgatatatataattatttatttaattttaattgttttacattaaatgtattaaatttctataaccataatattagtgttacaaatgttttctacaatatttttaaagtaggcttatgtcttcatccattgtgctacgtaaactcctttaaaaatttctctttattgtataattatcttataaatacgaacctttctttattt

SEQ ID NO: 154 - DNA, 1932 bp, Plasmodium falciparum
aaaaatttctctttattgtataattatcttataaatacgaacctttctttatttatacttatcagatcattgaatatacttaaaaatgataaaattaataaaatcatatattcactaatttttggggaacagattaatgaatgctttttacataaaattttatcaaatgaattaaaggatccttatttttatgcatatttttttgatgcacataaaaaaatgaatatcaataaaaatacaaatgatgatatggaatttgaagatatttacacatcttccataaattacttattacctgaatataacaaggaagaagaagcttcctatttaaatctaattaataaatattataagaatatggttacaaaaatattaccttgttccaaagaaaatggtaaaggagaacaaggcgaaaaggaagacaaaagaattgttagtgaggaaaagaaggaaattgaagaaaataaagaaaattgttcgattatccaagaaaaggagattaacaagacgggtgatgaagataaggagattaacaagacgggtgatgaagataaggagattaacaagacaggtgatgaagataaggagattaacaagacagatgatgaaaataagaagattaacaagacagacgataaagataagaagattaacaagacagattttgaagaaaaggatattagcaagacagattctgaagaaaaggatattaacaagacagattctgaagaaaaggatattaacaagatagattctgaagaaaaggatattaacaagacagattctgaagaaaaagatattaacaagacagattctgaagataaggagattaacaagacaggtgatgaagataaggagattaacaagacagatgatgaagaaaaggatattaacaagacagattctgaagaaaaagatattaacaagacagattctgaagataaggagattaacaagacggaagatgaagaaaaggaaattaacaagacagattctgaagataaggatattaacaagacaggtgatgaagaaaaggatattaacaagacagattctgaagaaaaagatattaacaagacagaagatgaagaaaaggagataaacaagaatgataataaggataatcataataaagaaaaagttgatgaagataaggatattaacaagactgatgataaggataatcataataaggataaagttgatgaagataaacagattaacagtactgatgataaagataagaagaataatagtacttgtcaggaacaaaaagaaaaagaaacagttgttaaaaaaggaaaacaagatgaaccaagtgttcataaagaaaaggagttgaaagatcaagaaaataaagaacatgttaacgaaaaggataataaaaaaaaggatatattggatcaaaattttaaagagaaagatataaatgaagaagcaactgtgatagaagaagaaaacaaacaaactaagataaattgtatgaaagaaaatgagaatattggtgatatagaaaaaaatttaacaagtaataacataatgaaatataacgaattaagtaacccaatattacttaatttcatgttacttactaatatacaaaaagagaaaaatattaaaaaatgtgaaaaagataatattaaaaataaaatatcagatatatatttattgttaagtatccagtttatttataattatttaaatacatcagatgatgatttgaataatatgaacatttctttttttaaagtgtctaattacaatttcttatatatttattggaacattataaatgtccatataaataatttatatttacgaattattacattgaaattgttagttaatttgacattattgtatgttcagaaaataaaggataaaagtgtgtgtaccgaatttgtaacaccattattatcattagtggaaaag

SEQ ID NO: 155 - DNA, 2085 bp, Plasmodium falciparum
atgggtcccgcgcctaggacagcaaccactacatacagtagtgccaaggaccttttggaagacattggagaaagtgtgcagaaagaagcaaaaaagcaagctcttggacgtagtgagagtgttttgcatggcttgttgtcaaatgcaacaattaaaggtgtgaaaaacaaagccacaaaaccaatccaacttgaatatgaatatcacactaacgttaccggtggttttgataaaaataatccttgcgcaaataggttggacgtccgattttccgatatatatggaggtcaatgtactgataataaaataaatggaaatgatgatgaaactggtggaacgtgtgctccattaaggaggttatttctatgtgatcagcatttgtcgcacatgaaggaaggtaatattaataacacagataatttattattagaggtgtctcttgcagcaaaatatgaaggagattcaataattaataactatcctgataaccgtgacaaaaaagaaggaatttgtacagcattggcacgaagttttgctgatataggtgacattatcagaggaaaagatctgtttcttggttataccaaaaaagatgaaaaagaaaaagaaaaagtacagaaaaatttaaaaagaatattcaatgaaatatataaaaaaatgcaagatcctgcaaaatctcattatagtggtgattcttcagatttttataaactaagagaagattggtgggcacttaatagaaaagaggtatggaaagctatcacatgtaaagcaaaaaatgatgctgaatattttagaaaaaaagattctgatggaaaacattgctctgttcaaaattgcaaatgcgttgatggagatcctcctacaaatctagactacgttcctcaacatttacgttggtttgatgaatggagcgaagaattttgtagaaaaagaaaagatcaattaaaaatttctttagagaaatgtcgtggaaaaaataaagataaatattgtagtcttaatggatgcaactgtaaaacaactgttagaggaaaaaaaaaattcgattatcaacaagaatgtaatgactgtttggttgcatgtgatcctttcgtacattggatagataacgaaaaactagaatttttaaaacaaaaaaaaaaatataaaaatgaaataaaagaaagagaacctacaaaaaaaacatcacatggaactatcaataatatgtatgccaaagagttttatgaaacactggaaaaggaacatagaactgtcgatacatttttaaaattattaaatgaagaaaaagaatgtaaaaatcaccctgaagtaggagagggaaaaaaaacttttattgactttaatgataatatcgaaacattttctcatacaaaaatttgcgaaccttgcccttggtgtggagtgaaaccgggcggtccaccatggaaagataacgacattgattcatgcgggaaaaaagaaatatcgtttagcgataaagatactactgatatatcaatactttccactgatagagcaaaaaaaaatattttacaaaaattagaaaatttttgcagagatactgagcatattaatcatgatatttggaaatgtcattatgagaatactgataatgataattgcatactacaaaatgagaacacgggctcagaaaaacaaaaaattatgccctttgatgcattttttttcctttggctaacacaaatgttagatgattctatagaatggagaaaaaaacttaaaacctgtataaataatgaaaaaccaactaattgtatacggggttgtaaaaagccctgcgaatgttttgaaagatgggttgaacaaaaagaagaagaatggatttcaattgaaaaacattttgacaaacaaagagatatatcagaagaagaacgttatataacacttgaatatattttgaatgaattttttatggataaaattgaaaaagcttatggaatagaaaaatcaaaagaattaaaggagaaattaaaatcaaataaaggtcacggaattataagagatacagaacattcacaggatgcaataaaaatattgctagaacatgaattagaagat

SEQ ID NO: 156 - DNA, 2079 bp, Plasmodium falciparum
ggagactatagagatatatgcataggtgatgaaaacgtgattaagacgttaaaatatagtggtgataaagacgacattatggagaaaatacaagagaaaataaaggctgtttttccaactagtggcggcacatctcacatacctgatgtcaaacctggtggcgccctatcgcgcggcgactggtgggaacaacatggtaaagatatatggcatggaatgatttgcgctttaacctataaagagacaagtggtagtggcgaaaagggtgaaaaaacaactattacccaggatggtactctgaaagatgcacttttggataccgacggcaaaaagccaaaacgtgactaccaatacacaagtgtcacacttaaagaagatgatagtggagaaaaagccgccaatgtcccggccaaagtggaacccactacactggccgacttcacgcgccgcccagcgtacttccgctggctggaagagtggggcgacggcttctgtcgagagaggaaaaaacgattggcacaaattaaaaaagattgctacgaagacggtggaacaggtgaaaaacaatacagcggttatggggaagcgtgtgatcgaacaaatacatcaaatgaaggagcttctgctgatttagaaggtccaagttgtgcaaattcttgtagttcttatagaaaatggatagaaagaaaaaaatacgaatttaaaaaacaagaaaaggcatatggtggacaaaaacaaaactgcaaaaaggaacgtaaagctgctgaaagtaatgataatgataaacaattttgcggaacaccagaaacaacatgcaatacagctgaagcatttttacaaaatttaggatcatgtaaaaagtataatggagagggtaaaaaaatttttgagaatacagaggaaacatttaaacctgcaatcgattgcgaaccatgttctgaatttaaagttaaattagaaaagtgtaattgcgggagtgatgctaaaggaaatacttgcacaacaggaaagattacggcagaaaattttgaaaataagacagatgttaatgaagttgttatgcgtgttagtgataacgctgaaagtggttttaaaggtgatttaaagagttcttgtgaaaacgcacatatttttgaaggtattaaagaaaataaatggaaatgtcgtaatgtatgtggttatattgtatgtaaactggaagaagtcaatggggaaaaagataatggtaaaaaaattttattaattagagcattggttacacattgggtagataattttttacaagattataataaaattaaaaaaaaattaaacacatgtatgaatagtagtgatgcaaccccatgtataaagggatgcgtagataaatggataaagctgaaaaaggatgaatgggaagaaataaaaaaaccttaccttgaacaatataaaaatggctatggagaaaattacaatgtgaaaactattttggagaaatttcaagatcaacctgaatttaaaaaagctataggaccttgtccaactttagatgctttcgagaagtcaaaacaatgtaatgcaactgcgagctcagaaaagggtaaagatggtaacaaaagttatgttatagattgtttgcttcaagagcttgaaaagcttcaagaaaaagcaaaaaagtgtcatgaccaacatagcgacaatccacaagaaaaatgtgatgatccccaccctgacgaacccgatgaggaggacttactccttgaagaagaagaaaatacggcaaatagtgcgccagaaatttgtaaagatgtgataaaagcaccaccaaaacaagaggaaaaaggcggttgtgaaccagcatcccctcttgaacccgaagaagtggaagaagaaacagctagtgtcccacctggatcagaacctgaagctgataaaggcccagtcaaacccgcagaactaccaaaaccaccaaaacgaaacaaaaggcaaccgaaaaaactatatttcccaactcccgcactacaaaatgcgatgttatccaataccattatgtggactattggaattggttttgctgcaatcagttacttttttctaaag

SEQ ID NO: 157 - DNA, 1044 bp, Plasmodium falciparum
aaaaaaaccaaatctactattgatcttttgcgtgtcattaatatccccaaaggagattatggaatacctacaatgaaatcaaaaaatcgatacgtcccttacaaaagtggtcaatataatggcaaaaaatatatttatatggagggggatgaatcggatgactacacatatattggagatatatcatcatctgatattacttcgtcagaaagcgagtatgaagatattgatataaataatatatatccatataaatcacccaaatacaaaactttgattgacgtggtactagaaccatcaaaaagagatacgtttaatacacaaagtgatataccaagtgacacatctacgaataaatttacagataatgaatggaatcaactgaaacaggattttatttcaaatatttcacaaaattctcaaatggatttacccaaaaataatataagtgggaatattcaaatggatacccatcctcatgttaatattttagacgatagtatgcaagaaaaaccttttattacatctattcatgatagagatttacataatggtgaagaagttacctataatattaatttggatgatcacaaaaatatgaatttttcaactaatcatgataatataccaccaaaaaatgatcaaaatgatttatatactggtatagatttgattaatgattcgataagtggtaaccataatgttaatatttatgatgaattgttaaaaagaaaagaaaacgaattatttggaacaaatcatacaaaacatacaacaacaaatattgttgccaaacaaacacataatgaccctatagtcaatcaaataaatttgttccataaatggttagatagacatagaaatatgtgcgaacagtgggataaaaataaaaaggaggaattgttagataaattgaatgaagaatggaataaagaaaataaaaataatagtaatgtcacagacacaaatggtgaaaataatattacaagggtgttgaatagtgatgtttctatccaaatagatatgaattctaaacctatttaa

SEQ ID NO: 158 - DNA, 2967 bp, Plasmodium falciparum
atggattatagatttgttttgaagcaacaagagttatatatccatatagatatggataaggaaagaatagaaggaaatacggttatgaacatttctctttatatgcccatttattatttatacgatgaagaagattttattaagaataactataatataaataagcttaaaatacgaaaagaagaaaaagataagaagaaacagatgaaagaaatttttttacaacaagatgtgtgttacaaaaaattttgtgaaatgaaaaaagaaaagaaattatttgtaattcttcaaattccacataatattaattcaagttcgtattacgatatagaattaaataataaggtacatgataaatattacataatatataatagttcacatagtgcttcttcgtatgataaaataaataagaaaactgaagataataatataaatgaagcaaagcatatgaatgtttataacaataatgaaaattatatggtaaaaaaaaatacaaaaaatgtttcttgtaataaagaagaagatgaattaattttacctaataatttaaaagaaaaggatgataaaaatacaacaagttatgaaaatgatgataaaaatacaacaagttatgaaaatgatgacaaaaatacaacaaattatgaaaatgatgataatattatatataataatatgccatatgatgagtatagagaagaatgtatgtccgtagaaagaagggattttgaattacaagatactttgaatattgctgattatgtttctttaaataaatatgtggatgaaaattatatgaaagaaaataattatatgtttataaatatagatcaagaaatattggataaggaaaaagataagaattataaaaattttcttcatttttgtaataatgatagatatgtaattacaaatacaaatgaatataatataaaaataaattttattataggtttgaaattttccttttataatttaaattcatattataataaaacatattttaataaaaaaaatgaacataatttacttattactttacaaaattattcaaaagaaaatacatggtttccaacactctcaaaattcgatagtatatattcaaaatgttcatggctaaccatgtttaaaattcataaaccttattttattatttcatccaatactttaataggtatatacgaagaaaaatatgaacatgaatatgtaaataaagatgaaaggtacggtgaaacaattaataaaaaagaactcgaaaggaattgctttgtttataaaacaacaaataaatatgcaaaattattccctcatcaaatttgcgtttttgcaggaacattcgattttctacacttaaataatttaaattttaaaggattcgaaaaaattaattatgattttttgtacaaatatgaaaatatgtacaaaaataacaaaatgtataattccattgaacaatataataaatataaatataaaaattttaattataaaaataaatataatttattcaaaggagaaaaaaaaaaaaaccaaaatggctattttgttagaaatgacctgaacggttcaggcaaaagaaaacgtacaaattcgcaacatttgtattatgaagattcggatagtttgaatgaggacgataatatgggtagtcgaatgaatgtcgctctaaagaatgatattaataataatgaaaataatgataataataataatgaaaataatgataataataataatgaaaataatgataataataataatgaaaataatgataataataatgaaaataatgatgataataattacaataattacaataataatgaaccttttgaagacaatttgtcaaatgatgaaaaatatagtcaagtaaaaaaaaggaaaacagatatgagctccttctctttaataaccaagaagagttatgacaaccaaaatgaaggaatgtgtaattatataaaaaggaatgattataaaaagaaaatagaatcttttataaatatggaaagacaaaaatgcaataatataaaatataagaatttgtttgaacataataaaaaagaagtcgatgctgatgatgaaataacatatcattatcaaaagataaatgataagcgtgttcctaacatctatatattttctgtaaaggattataaaaatgaattaatatatacaaatcttcatattggatatattttaaggaattttttagatattagtaaggaagattttccttatgataatttaataatattatatcttcctattgaattttgtgaattaccaagttttttttataattcagaaaatatagaaagttcttttagctgtcatatatatgatgatataaagaatggatataatttattttcaaatagtaatatattaaattataaaattattgaaccatatatatatatgaaaaataataagttctttatatttggaaatgtacttattttccctacaagcatattacataatatatatgatgttttatttaatatgaatatttttagttataaaataataatagcagaagggttattatctttatgtcttcaaaactatacagatactatgaaaaatgaaaatatttatttcttgtatatgcttaaaagttttatgttacaaaaatttattgaaaccatgtttggaaatgtggaaataaatgttatcttttatgaattacgtgaacgttattgttcgctagttgaacttttaggagatattaatttatttcattcttatgaagaaaataaaaataatatatcacaagaatttcctagtcattatatatttaataatttattctatctgaaatgctttttatgtgtacgcatctttttcaacatacttaaaaatttccctttttgtaatactattcatcaatattgtttttttcttttctttaattattttaaaagcaagggaaaggttatacaatcaacaaagttttggaaaaag

SEQ ID NO: 159 - DNA, 1566 bp, Plasmodium falciparum
aatatcttgtataaattgtttttaaaaaaaaaaaaaaaaattcaaaacattaaatatggacacaatcaaaattgtacgtctattccattagaaaacttatatcaattcttaggaaacaaaataagtatgaaacaaaattatgagaaaaaacattttgtaaataatgaaagcaacaacaaaaatatatctataaataattctcaaaatacaaaaggtagtaatattccaaacacaaatcaaataaaaaatatgtttaataatattaatgtagtaaataataaaagtgtatatatggataatgtcttaaatacaaacatagagaaaggaaatataaaaaataaaaattctcacactaatgttggtaataataattatgatgttaattatgatcaatcattttctcaacagaataaagaacaagaatataacaacacaaaaatgttattagaaacaaagaatggaaataaatcttctagtgaacaagaagattatgaaaaatattcttattcaaataatataagttcatatcaaaatttttattattatgatgatgacgattatccatattatccatttgaaataaaaattaacgaaagcgatgttgcagaaacatgttatgaaacagatattatatcaaaccattcgtctaatgaactaaataacgagaaatgtacaaatatgggaaataattcattttgtgatgaagatatagaacatgttatcaacagtcatcatgaacaaacaaataatacaacatcatccctaggaagtagtagtagtgatatagatatgatgaaaactacaactactaatataaaagaaaaaaatatatatataaataataataataattattattatgactattattacaatatgtatgacgatgttgtatcctccagtgctgatgaaaagacaaaatgtgagatattagaaaaaaataataaatcattttttaaaaaaattagaaaccatttaaatatttttcattttaacaataaaacgatctacgataatgataataattctcttatagatttcataaaaagggttcaaaaaaaaataaataaatataatatatgtaaatgggatatagaatatattttaaaagtaattaaaaaaattgaacgatttttcattacaattgaattagaaccaaacatgacaaatgattattttcatatgtactattttgatatacatgaagaaaaaaaaaaaaaaaaaaaaattaaagaaagttatgatgataataatgtaaaggataaatataatgaacaaaatattatatataataaaaaaatgaaaaataaaaaatatgtcacaaataatcaaatgaaagaatatttatacatgtctttattttcaaacgataattatttttctcttgttcatttattaaatattcaagactattataccatttgtctatatataaaaaaaataatacttattaattccataagcgttaaaaaaaaaattaatatctttaatattatcttatggaccatatataattttatgaataacaagaaaactattatgatggaatacaaaaaagataataat

SEQ ID NO: 160 - DNA, 2289 bp, Plasmodium falciparum
tattactttacttgtaattattccgtgataaaatctaataaagaaaatatcttattacataatagtagtgtacataaaaaacacaaagacaagaatgttaaagatataaaaaaggaaacaaatgatattactatttttacatcagcagatattaattcatttattaaaacattgttaattataataaattatgacattcataaatttaaggatacagaatatcataaaacaattgaacaagttattaaagataatgattggtatgttatatataataataataataacaataataataataataataataataataataacacctcgtcccttttaacctcctcctcctcatcatcatattattataataaggatgaaactagaaatatgagctttctatataatgatgcttttagttcaaatttggattctttttcagatagtataccttcaacagaatgcagcgatttagaatttggagatatattaaacgaatgtaataataatatgaaaaaaaataataataaaaatgaagaaaaatataaagataagcaaatatcatttatgaatatttttagccctaatgaatggaagtataatatatatgatatggatgaaatgtataatgataaaaaaaaaaaaaaagatgtacaagcagattatatagaaaatgtaaaaaggatacaaaatgaagaccttataaaacatccaaataatacatctataggaatggtaaaggaggtagaaatttttaataaagatatgaatgataaaatagataatataaataatgaaaaatatatatcatataataatagttcttattataatgaagaacatgaaaaacataaaaatacaaataatgataatcttatattacaagaagatataaataataaggaaggggaaaaaaaaataaataatgataaagatatgtataataatgataaagatatgtataataatgataaagatatgtattataatgaatatgatgatgaagattatcaaatgcacatttcaaaatcaaaagatattattttaaataaatatggagaaggatttttatcaaattttataaacaaattgaattatcataataataacaaaagtaacaataattataataataataataatgagtgtaataataataattatcataacgacagttattgtaaaaaacattttagacatatacataaaaaatcacaaatgataaatttattaaaatatgtcaagtttattttaaaatattggaatatatataatttaattaatgaaaagaatttagaagaatatttgttaatattattttttgctaatcattttaattttttccaaaatatgataaagtataaaattatattaaaactatttattcataataatttacaaaaagcagatgaactcttaggaaataaaagtatggtttggaattggtacagaaatactggaaagattaaaacaaatattgaagaatatttaatcaaagatatttcttgtaaacttttttttactaataataaacaagatcaacttttaaaaaaattaaataaatttcaatataaaaataaatatgatcaaaataatttttttttaaaaaattattatcataataaatataatcataattatatttcaagtgtatatattcaatatcttcatttcctaaaatataaaaacactcataaaaataattattccaaaaatcaaaggacaaaagaatatgatattattataaacaacaaaaaaacggaagaaaatgtaaataattataatcactccataaatataaatcaaactgaaataaataataacaaatatgttaatcatcataaatattttactcacaataatataactcaagataatagttatattaataataataataatagtgaatcttatgaaaaaaaaagacaaacaacagattatattcctcaagatgaatataatcaactaccattgtttttcttaagcttattagacctttataaaaatacttttgatgtctacgaattttattatcaatccgttatttataaattattgaaaaataataatgaacataatattaatgaaattcaaaattatgttgaagacatgaacaaatatctaaaaaataaattagcgtcctatgatttatatatgatgttatattattatcaattttttacctttcaatctatttgtaatcctaaccaaaacgttctcaataaaaatgaacaaaacttaattgtatatatgtgggtaaagcatacgcagggacttttaaaaaaatacagg

SEQ ID NO: 161 - DNA, 1074 bp, Plasmodium falciparum
ggcataagacaaatacatattatcacacacagcatgggaacaaggatgttcctactagcctttcatgatatcgtaagtagcgaattattttcgacgattgaagaaaaggaaaaagatgaaaagtatcaaaacaaaatgaagctaataaccctaactatgatgaaccctgagtattatttaagcgatttcgtaaataaagaatatatatttcttcgctcattttgtacagtgatttcaatatattgtgattctaatgataaagctttaaaatgggcagaaatttttagtggtactaaatccttaggaaaaaatgtgtttgatttaaatataagtaaagaagatatttctaaaaaatataatggacgaggtgtaaattatttatttgatagtaaccaattagattattattctatttctatggaaaataacaaaaaaattcctaataaaaagaatatgaacatacaaaagaatacagatgataaaatagattacaacatagatcataatattatatcatcattttttgattgcgaaaatttagaaattacaaataacaaaaaaaaaaataaaaaattcaaattcaaaatcaaaatagcagaaaagttaagaacccttgttcactttttttttggaaaagaatatgtaaaaaacaaaacttatattaatgatcaaaattcattacaaataaatgacaatgacaatgatgatgatgtagatgaagatgactgttctttaaataaaaataaaaaacaaaatattttacatcagccacctatgttcagaaatacattactagtatttactggaatagaacctacttattgttataaagataatcgtgattggctagatgtagatgtcattgatactacttggttaggttcaaatgtacatacattgagacattcttattggtcattaaatagagaaattattgaagatataagagaattgatagttactagaaaaagagcaagacaaagaacatctcgattggatagaagagaagggaatgtatgggtatatcgtgtagcaccttctcatttaaaatcaatatttgattcggacatataa

SEQ ID NO: 162 - DNA, 1434 bp, Plasmodium falciparum
atgaaggtgtggggagcttgcttttttgttgcgttacttgctgggctgatcaaaaaaaaagttgaatgtattgaacttagtgccagcgaaatttcccctcatgaaaacaaatcgacgagttcatcaatattccaagaggaattaaaatttgataagtctctgaaaaattttttcaaacaaaataataagaatgaagatgagatagagagggataatttctttgatgaaaataaaaactttataagaggagaaatattatctgatataaatagtaaattccttgtggatatattaaacaatagtactttgaattttttggaaaacttaaattcagataatgaaggggaaaataaggattaccaaatagaacttgaggaaaattgttcgcccttttattgtgagaaaattatgaaggcaaaggaaattgaacgattggacgatacaagtagctcagaaaatgtaaaaaatgatgataataaaaatatgagtggtgataataataatgataataataataatatgagtggtgataataataataatatgagtggtgataataataataatatgagtggtgataataataataatatgagtggtgatgattatgtagaaggaaaacaaaacataaatagaaatgaaagaaacatagaacgacacaataataatgataataataataataatttggtaaagaatatgaacaacatggaagaattttataataataattatgataacaacactgacgatggtgtagatgctttatatttaagatctgttgatgatggtgaagataaacaaagaattgtccttacagatggaaataatgtatatattttagaagaagttacaaaaaatgaaaataataactcaacaatgaataaggatgaaaataatattaataaaattacaagtgttgaacaagaaattaaaatgcatgtaccatcagaacaaaattataatgaagataatatattagaaagttttatggactatataaatttagaagattcacttttaaataatattgatgatgtaacgaatatacaaactggtagagaaacaaatatacgtccacacaataatacaaatgatcataataataacacaaaagattataataataacacaaacgatgaacaaaataaacaacaatccctttttgatgataatatatttaatctaagtgaagaagaattatcaaaaaaaatttttgatgacatcaaattaaacagtgaagataaaatcgaatgtcataatttttcagataatgaagataaatgtaatagttttaaaaaatgtacttatgtaaatattgataataaggatacatgtttccttgattacaattatatgctcttcttaaaaaataataactgtgccttacaatcaaaatcatctttgttgtctatatcgaaagatttgttaaag

SEQ ID NO: 163 - DNA, 1806 bp, Plasmodium falciparum
atgaataatgtcgcctatgaacccttggtatacctacttttaaattcattaggttttttgctatatcatgagaatataaaaatggatgtccaggatgatcagaaggagttgcaattttttaatgtggataagaaagaatatgaaacattatttgttgaaatatgttttgattacttgaatatattaattaggaataagaaaaataatgagaaggaagattttacaaaatttctgaggaattattttgatatggtgaaatgtaatttatatatgaataaggatattaatttatgtctctataatataaatgtagatatgttttatgttttttttgagagtgatagtaataataacaataataataataacaacaataataacaataataataataataataataataataataataataataataataataataataataataataataataatttgtatgcctttttagaaataaaggataaatatttacatgaacacgattacaataattttatatttttacccttttttgttatttcaataaatgatgacaaaaaatattttacatatgtacatgatgatacatttgatgatacgacgttttgtttttgtattgattcaaatgaagaagatatgattaataaacttaatttggacatacataatgttaagaatagaaaaataaatgataatatacaacataacgatagttatttatgtaaatatatggacagaacaaaaaaaatggttgtaagctttattatttcagaatggaagaatgaaatgaatgttgattatgtggaattatatctttttatatttaatcaactcataagaattcgtgttaataaaatatatgtttctcattttaagaagaagtatatgaaattatgtaatgatgagaaaaaaaaagggggtagtaaaaatcaatatgacgataattttgttgttaatagtgtggatgttaatagtgtggatgttaatagtgtggatgttaatagtgtggatgttaatagtgtgtatgatagttcatatgaggaaaacactcatggtattaataataataataataataataataataataataatagtaataataatagtaataataaaaattatagtaataatagtcataatataaattataagaaagaaataaaacagattgatgacaaatgctcttttggacatgtcctaaacacatttaacaaatatgatataaataatgcggaagaaaaaaaaatcttcccaataaaaaatacgaattccttaagaaaaaataaaattgattattataaattaaaggatggaatatatataaataaatatgagaataaaataatatacaataaggataaatatttatacaaaaagtcattgttgaaatatgttaattattatatatatacaagaaatgataaattatatttgaatgagtataatatatcttatatatttattaagtattcaacatatattgagaattttgagttaaacttttcttttgtgatagatgacatggatcatgtggacttttatttattgagcaatgaaaacaatgtcataagtatccataaaattaaaaacagacagaacatatccttaagaggaaggaaaggtatgtataaatggtacaataatcatgctgataatattgttttaaataatgataaaaaggtaaaggaaaaagaaaaaaaagaaaattatatttacatagacgatggtaacgaaacagaggataattcaaattctaatagtagtctaagtagtgataccgaagaatataattcttatagtgatgat

SEQ ID NO: 164 - DNA, 2124 bp, Plasmodium falciparum
aataataataatgatgatgatcataataatgataattataatgataattataatgataatatttttcactgctatgaaaaaaaaaaaaaaaataatagacacacatccatatttcgtcaaaataataaaaagttaccacatgttattccattatctctacttttctacaattttaatgaaaaatattttatggaaaaaaataaagtcgatcaatctaatagtactattttatatatacataaaaaaaacaaaataaaaaaaatatgtatcctggatcatttgaagaagctaaataaaaaatgtaaatttattaattatatatcgtacaatgatatagaatatgataataagtacataagtaagaaaaaaaaaaaaaaaattatattaaatgaaggatataataatgaaataaataaaaaatccaaaaaccattcttccatgataaatacaagtaataaaacaattgtaagtagcgatatacataatacatctaacattttaccacaatttattttccaaaatagagaatcacaagcagatgcacatatagaacccaaaaatgaaaacattcaaaatggaaaaccacacattcttcaattacaaaaaaggtctttaggttcagatagtatatatgatgaaaatggaaatataaatgaacaaaattttaatgtaagtaataccatagaagaagaaggagaaggagaaggagaagaagaagaagaaggagaaggaaataatcaaaataggaatgatcataataatgatgctagattaaatcatgaacaaaatgatttagtaaaagaggagaaagaaaatatgaacaaaataatgatacataataataacaaaaataatcataacaaaaaaaatcaaaaagtttttctagatattaatatgaataaattattatatatatataaatgcatgcacatacaatgtatgcataacctaacacctttatgttccttcctaaatacatttgtacctaatgattatagtataaccaatttttttcataatacatataacaattattttgtgaataatatatttttccataattttttttacacatatgataatagtttaacattattattgaattctaataatatgaattcgttacattatcataatgatataatatcccatgtggattatggaaacgagcacgacgtttataagaataatagttatgcaccaggtgggttcaaaagcgcaggcgcagatgaaaatttaagaaaaaagtcgtctaagggaagaaataaaaataaaataaataatcatatggatgataattacaataatggggccaatatttacaataatggggacaatatttacaataatggggacaatatttacaataatggggacaatatttacaataattttgatttgtctagtggatatgaaaaaaaagaacattttaataatttacatactgataaagaaaaatacgagatagaaaaaagcaaaaatataaaaagtgtaggaataaataataaatataataataacatgaatgcatatgatgaaataaaaaacaatttgattatctccaagacagctgaaaaatatatggaaatgttactattattattatataataacatgcgtttatatgataaagataaaataaatgatacaaataatacgaagaagaatgaatttagatatttttttgaatatatagataaaaatataaatagttgtataagaaaaaaatataattttataaatcagttatcagatgaacaacgaaatatatctttttttaaaacaggtggaataatatctcatccatttttacccttctttgcattaatacatataaataataacgaaaaaaatatgaatgaacaaattatagataaagaaaaatttcaaattaaattttgtagattcacagataattatgatgatatatcttataaatatggaagtattacaagtatgacatggaatgattctggtaatttattaatggtttctgatgacgaagggtatttatatatatataatattttcttaggaaattttatatggaccaaaaccaaagaacgagctttatacaaaaagaacctgaccagttcatcaaaaaatgcatcgaaagaaacaaaa

SEQ ID NO: 165 - DNA, 2121 bp, Plasmodium falciparum
ttatacaaaaagaacctgaccagttcatcaaaaaatgcatcgaaagaaacaaaaaataaggatataccgaatgttaccaatgataatacttgtagtgttaaatgtgtaagtgattatcgtcaagaagaaaaagaacgtggacaacattataaaggtaggaaggatgatcaagagacttatgaggaggaatatgatgaagaaagtgaacaggatgattattacgatgatgattattatgatgacgattattacgatgatgattattatgatgatgattattatgatgacaattcctataatgacaattcctatgatgacaattcctatgatgacaattcctatgatgatgaaaaaaaaatgaataaaaaatcacttccttacaacaaaacacaaaagagataccaaagaaaggacaagaataacaaacttcgaaatttttttaaagagaacatattaaaaaagaaaaaaaagtatatgatggaaaaagagacgaaagatatgatatatatgaaaaatatgagaaagttacatattatgagaataaaaagaagaagaaaaaaattaaataaaaaaaaaggatatattataaaagaagctatgtgtgtaataaaattacatgatcaaattattgatattaaatatttaaatgataataacttttatataatatctattggaaaaggtgttaataaaaagtgtttaaacaataacactgtctttataaattcgtattttatgaaaagtcaagaaaatcatatgaacaaggaaaaaaccgaaacaccaagaaactgtaatatatataaggaaaatatgatgaatatgaaatcttttatggatgataataaatattcaaacaatatgatgagtagtccttatatacaatatgttaataatttaacaatatcaaataataataataataataatgatagtaataataatacagtatatgataaaaaaaaacaaaaagatgatcaagaagaaaatgaacttcaaaaaattaatgatacaaatacaaatatatatgaagtacaagataaaacacaaaatactcatcatattattcctaccaatttaaataataataataataataataaggagaatataacaattcaaaatgatgagaagatacatcaagttaaaacatcacatgtacataataatagcacaaatgttattcaaggaataaatgaaaaaaatgctatattagacaattttaatataacaaaaaaaaaaaacaaaatgtacacaaccaaaaataatgatactagtaataataataataataataattactataacaataataaccatgttgatacctttttaaatcaacatgttttaaaatcgaaaaaatcctactttaaatcacggtttttttattttgattcatccaatattatacccatgaaattttttaaaaaaaataaaaaattacaagaacaaaatgatatacttgacaatatatgtatttgtatttgggatatgtgttctatactaaccaatgaagaaaaacaatatttaaaaaataaaaatgtagaaatgaatacaaatgaaaatgtgaataataaaaccgaatcaaaaaaaatgaagaaaaaaaaatcggttatattacatccatcattagtttgtgttattagtaatttatcaaaatattatattaataatgaaaatataaaaaatatgaattcttataataataataataataataatataaatctttataataataataataataataataataataattgtattactagtttttctgtatggacctcaacctttacaaattacatgtacaaatcagtgtgtccttttgaaaaacaaaatagtatgccattaaatgaagtaggaaaaaattctactgaattatctgaacctcctaaaaaaaaaagtatattctggagtttgtttaaaaataaaatacattctgatcatttttcacaagatgcatatattttttatggtgatcaactaggatatattcacttaattcatcttcaactacatagagagatttactgctttaagccttttgattttccaatttttaaaatatttataactaccaatatgtgtacgaagttattgatattggcagaggacagg

SEQ ID NO: 166 - DNA, 648 bp, Plasmodium falciparum
ctgaaaatttacgaaatcctcccggggcttcaagtggttttcatcaaagaaatcgaaataaaacatgatgtaagccccaagaaatgcatatgtgaagaaaaaattcatgaactaaaagaaagaaggaaaaaagaagaacatgaaaatgaaggaatttctatttttaacctctcttattttttatcatcaaattatcataaaaaacaaagtaatacaagaagtgatgaaaaaatgaattcatcatataattattcatataatcgtatgccatctgataataacaaaagtaataatttattaaatggatcagcacaaaatgttaatacaaacgattcgaaaaaaacagtacaattatattctttccaaaaaaatgataagaaaaaagaaaaaaacacaaactcttcttttaattcaatatctcatttaaaaagtccaagtgaaaatagtgaagaaatggatattcatagtgataaagaaggatatcaaagtgttattataggaggaatcaattttggatatttaggatttaacttttccaagtttatgaataataaaaaaaaaataacaataattgatgcatatttgttatctacaacacatttagtaaccatatcgaataatggaaccattgccctcataaaaatatga

SEQ ID NO: 167 - DNA, 1548 bp, Plasmodium falciparum
atgagcaagctgtgtattaatgagtgtattccgtacgttcagaaatatgaatggggtaaaggaaaagatggactggtttatgaagtgatgaaaaatatagtgcaagataatcatgatattataaaaaaagaaatagatcatttggagtatttgagagaatatatggatgagtatgatgataataaagatgatgaggaagacgtggaaaaagatgatggtgtaaataataatgatgaggaaaaaaatgggaaagacaagaaaaaaaaaaataaagaaaaaaaaaataatgaaaaggatggaatggataatgatataaataatgtgtcaaaaaatataagggataataataaaagtaatgatgatgataataataaaaataataataataatgataaatatgctgagctttggattggtaatcatgataaaagtcctaatttagttgtatataaaaatagtttggtaaaaattgaagaatttttaaaaatatatcaaaaaaaaaaaaataagaaaagtaaacttatgaaatttttttataaaaaagtagaaaacacgaaaaataaatatatgaataaaaaaaagttttcaacaaaatcagaagatattattaataagaataataatactactaaaggtagtacattaggtggagaaaatgatttgaaaagatattcagatattgaatttgcttctttaaataatgatagtacaaaagaaaaagaagatatgaatgaacaagaacaattattagaagaagaagaagtggataagaataccttatttccatatttatttaagatgttatcaatatcaaaacctttaagtattcaaatacatccaaatgaacagcaaacattatatttgaatacaatgaatcctcttttatataaagataaaatttttaaaacagaaatgtgtgtttgtattaattcaatgactcttttgtgtggttttatgaacatttttaaaatagcatttcttataagaaatattaaagaattgaatgatttttttttgaaaagaggtcaccagcttaaccaaaattgtgatagcacacatcaaaagaaagcggatgagcttaagtttgataagaagggtccaaatgaaattgttttgaaggatgatacgaattataataagaaagataacacgaacggtatcacaaaggatacattggatgataacaaggaaaaaaagcacaccgacgataacatcagtaaaaataaccataaaaataataacaataataataataacaataataataacaaaagtaataacaataataataacaagaacaataacaagaacaataatataaataaagaaaacaaagtagagagtggtgttgaacttgccttaataacccagttgttgtcatcttcgccatctgcttcttcctcatgtggaaatataaatatagattcaggaaaagatgagaaaaaagatatgttttatttatttgatttgttttattctagcaaggatgatcatgtggaagaagtattatccatgttatcaagaatatacatttatattataaactat

SEQ ID NO: 168 - DNA, 1542 bp, Plasmodium falciparum
gtggaagaagtattatccatgttatcaagaatatacatttatattataaactatgctttaaaaagaggtaatggattgagttatgatgttatatctgttattgataattatgcagaatgtatacaaaagtatgtttatgatgagaatttttattcttccttttataagaatgagaaatttttagaacttaatattaacctaggaaatcttattaaagtcgaaaaagaaaaattacaaaatagcttgagtgaaaataaatttaatacagatcttaccgaatctgatatggatgaagtagatgaagatgaaaaagatgagaaaaccataagtgatgatggtgttgtggattcatatgatgtgtcaaaaaaaaaagataaaaaaaaagtatcactagaatatgaaaaagggatggataataacaatgatcaattggataagcaaaaaaaaaaaacatcaaagggaaccaccaccactaccaccacaaacaacaataacaacaacaataataataataataataatagttgtagtagtagtaatagtagtgctatgataaaaggaattcattgtgaatatgataaaaaaaaaactgatgatgacggtacaaaggtgtgcgaaaaagaatgtgcaacgggatgctcaaacgaatatactaatgtatatgataatttgaacaaacaaaatgatccatattttataagtagaaaaaaaatcaaagctttttatgaacacatgtataaattcttaatatatcgtattctattagtagaaaatgataccttaaatgaatgtgttacttctataatagaaaaaaatgaaaaatatcaatcttttataaatgatgatgagacttttaagaagaaaacagagaaattatatgctgatatatgtaagaaaaagaattatgaaaacctatgtaaagaaacggaaaattttattatccatagtatttttgaacttttaaaaaatgtatcaatgtattatgctaatgatggaggaagaattttcctttttattttacaacttattaatttaaacgatggagatgttgtatatataaaacccggtgttatccattcctatatttctggtcattgtttagagtgtatgacaaattctgatcttgttatcagaggtggattaacaaataaagaaatcgacaaattaaattttattaaatatgttaattataaaaataattatcctattattttagaaaaagaatttattaattataatattatgtcttatagttatcacagaatgaaacatttcaaaattttatgtattaccatcagaccaggagaagtcattaattacgttttttcagaaaaaagtttcacttcatgtatagtactttcaaccaacagaaaagttaaaatcaaaggaaagaaaaatgataaaaaaaaagcaagtattaaaaatgtacgaaaaggtatgatactctttatagcccccagtgttatggtaactatatctaatttgtatgccaatccagaagatggaaataaggagtttgtgatatattgtgcaacttcataa

SEQ ID NO: 169 - DNA, 1110 bp, Plasmodium falciparum
gaaaatattgagagcctcttcattctgtgtcttttatatttgaacatacataaatataaagagagtttaaaattagctaactatattataaacattttacaaaaaagaaaagaaaatgaagaagaaataaaaaataaagtacaagataaagtacaagataatgtagaggataacgtagaggataacgtagaggataacgtagaagataaaatagaagaaaagttaaaagaaaaagaagaggaagaccatttaaatataaataatttatatatatacagtactttgcataataatcatttgaacatatgcgagaatatatgtatatatattaaaagcctttgttatttttttcaacgtaattatatatactattatataaatatgtgtatacttttaaatgaaaatttgaatacattgaaagagtgtatagaaaaaaactccaacttgtatgaagaagaaaaggaaaaatgttttgattccagaaaatgcaataataaagaaagtaaaaaaaaagagaaaaaagatattgaaaaggatcataaggagaaaaaaaaaggttccaagaaaaaaataaaagatgaaaataatgaaatgaaagatatacaaaatgaagaaatggatatgaaaaaaaacgaaatggataagaaaaaagaccaaatggatataaaaaaaaacgaagtggatatacaaaatgaagaaatatctatacaggatgaacaaatatgtaatcaagatgaacaaagtcaaaacacatataacagtgataagaataataataattataacaaaaatgtatatgacaataccaatatttcaagaagaaaggataaaagtaaggaaaattcatcttttaaaaatgtaaaaagcaaatcagaaatttctccttgtcacacagacaattacatattgaattatatcgaaagttcagaaaataaaattccactaaaagataaatatatgttgttatttataatatattgtttaaaatataatattattaatattgttatgttcatatatgaaaatcgaagaaaacttttaactgacatggctattaactctcatttatttcatcatctgactataaaaatatttttctcaataaaagat

SEQ ID NO: 170 - DNA, 624 bp, Plasmodium falciparum
atatatgaatattatcaatacataaatatatatatgtatcataatattatatatatatatatatattttattattattatttattttatttatttttattatttttttaaaatgaaagtttttatttttttcgcttttgttaattttttgtttgttttgaatttattttccccttgtacgtgtaaaaaggattatgggaaggaatgggttaaggataaattaagtttagtaaatttaaaattagagaaatatgataaaaaaaagaaatttgctcttatatcaggagcagctataggagccttagcattaataacacttataggaggtatttatatgactaaaggaagaaaaagttccatatggcataattcagaaataaatgatacactttatgatgttgttcttgaaacagtgaatcaaggaaatacagatgtaaagttggcttttcaaagaggagtaaaactagatgatgctgttcctagtgaggcaacatttaaaaaatatttaaaacaaaatattaaagatcgaaatttaaatttaacatggcaagaagaacgggaattatatagaatgcttccttatattcgctttaatgtcgaaagactagctgtatttcttagatga

SEQ ID NO: 171 - DNA, 2781 bp, Plasmodium falciparum
tatggaataaaatataatgagaaaaatgtatgcaattctacttttataagaattagatatcagaggattttgatacaaacagaagaattgtcaccgacacaagtggacgtacttaggcaaacattaataaaagatttatcaggtggtaggtccatagtaggacaagaaaatttgttaagtaataaactagataacgatcttataacaaaaaaattgatagaaagaggaattttaaaaagtaacataacaggaacgaaggaaataaaaaatgaaggagaaaaaaagaaagaaaaagaggaagttgtagaatatgaagaaattgaagttgaagtggatgaagatgaagatgaagatgaagaagtggaatatgtagaaattgaagtagacgacgacgaagaaatagaatatgaaataattgaagttgaggtggatgatgatgatgatgaagatgtagaatatgaagtaattgaaattgaggtggatgacgatgaagaagtggaactacttgaggataaagaagaaaaaatagaagaagtaaaagaaaataagcaactaaaagttgaatcattggaaaaaaaaccattagaaattaaaacaactccaaaatatccattcgtgacagatgaacaaaaggaaatagatccattaaaaaaaaatgaaataaaatcttacgatccttttaaaagggacacaattaaagcgcaagataatttaaatggaaacgaaagaaaagcatatgatccttttaaaaaggatatggttaaaccagaagataatttaagaaaggaagaaagtaaaacatatgatactttaaaaagaaatgtaacacaaatgcaagataatttaaaaagggaagaaagtaaaacatatgatactttaaaaagaaatgtaacacaaatgcaagataatttaaaaagggaagaaagaaaaccatatgatcctttaaaaagagatgcaacacaaacgcaagataatttaagaagggaagaaggaaaaccatatgatcctttaaaaagagatgtaacaaaagcgcaagataatttaaaaagtgaagaaataaaaatacaagatacatttaaggcagatgctataaaaacacaagatattttaaaaagtgaagaaataaaaatacgagatacatttaaagcagatgctataaaaacacaagataatttaaaaagtgaagaaataaaaatacaagatacatttaaagcagatgctataaaaacacaagatattttaaaaagagaagaaataataatacaagatacatttaaaacagatgttgtaaaagcgcaaggtaatataaaaagggaagaaataataatacaagatgcttttaaaaaagatgaaaggaaatctcaaaatacgtccaaaatggatgaaataacaatacaggataatttagggagagatagaataatagtaaaggatacttttaagaaagaagaaataaaatcgcaagatcatttaaaaagagaagaaataaaacaaaaggatatattaaaagaaaacgaagtaaaaaaaatagatcctttaaaaaaagaggaagccaaaccgaccgatctgctaaagaaagaagaagcgaaaccgaaagatccattaaaaaaagaggaagtaaaaccatcagatactttaaagaaagaagtgaaaccaacaaatactttaaagaaagaagtgaaaccaacaaatactttaaagaaagaagaagccaaaccaacagatttgttaaaggaagaaaggaaaacaaaagatactttaaaaaaagttgcagaacaaaagggaggtttgaccacattagataaaataaaaattaatacagttaaaaataaattcaaaatacgaataccttataaaaattcaaaagttattgaaagcaaaataaatgatattttgaatgcagaatatgaagatgcagatgaagatttaacaaaaaaatatagaatgaaagaacttatgagtttatattttgaggatatggattactttcatcaaagtgatatatataaagttattgaaaaatatagtaaacaaaaagaatattcttctattatgacacctatgtttaaggattttatggaaacacatcgcataagttctaaattaagtaaaactattctggtaacacttggactaattgtcatccttacaataaccttaggaatagtaggcattgccgctggatcttcaatagctactttttctacggctctctatgtaatggttggagtatgtgcatttttatcattgtcatttccaggtttattattttcaagggctaaaagaacaaaagcatttatagaaaaatattttaaaattaaaggcatagaatataacaacacgaatgttaataatataaattcatttcaaggggtagtaaaaaatatatggaataaaaaaaatagcacaaagtttaactcaaatgaaaaaactgtaaatgagaaatcgcaccaaaaaaatataagcggaaaaacacttccaacaaacattacaagtaaggcaccacagaataatgtacaaaacaaaccacgacagaatatacaaaaccaacatgaaaaaaatgtacaaagtaaagcacctcaacaaaatatacaaaatagggcaccacaaaaaaataaacaaaataatactcctgtgcaaaatacaataagtaaatctcaagtacaaaatagagtaaataaatctccagtgcaaaatgattattcaaaacataatggacgaggtcctaaccaaatgaatagacctaatcctaatagacatgtagcacaaccattaagataa

SEQ ID NO: 172 - DNA, 1713 bp, Plasmodium falciparum
aatttaaaatgtaatttttattataataacaacaacttatcaacatacgttataaagcataacagatttttatcagaatatcaatcgaactttcttggtgggggatatagtgcagctttaaaattagtaaatagtaaaaaatccggaacaaatgtaaatacaaagtataattcagaaaataccaatacaaataataatataccagaaagtagtagtacatatacaaatacaaggttagcagcaaataacagtacaactacaagcactacaaaagtaacagataataataaaacaaatattaaattaacaggaaacaatagtacaactataaatacaaattcaacagaaaatactagtgctaccaaaaaagtaaccgaaaatgttattacaaatcaaatattaacaggaaataacaatacaaccacaaatacatccacgacagaacataataataatattaacacaaatacaaattcaacagaaaatactagtgctaccaaaaaagtaaccgaaaatgttattacaaatcaaatattaacaggaaataacaatacaaccacaaatacatccacgacagaacataataataatattaacacaaatacaaattcaacagataatagtaatactaatacaaatttaaccgataatacttctacaactaaaaagttgactgataatataaacacaacacaaaatttaacaacaagtactaatacaactacagtatcaaccgataataataatataaatacaaaacccattgataataataacacagatataaaatcgacagataattataacacaggcacaaaggaaacagataataagaacacagacataaaagcaacagacaataataatattacaacaaccacggataatactaatacaaatgtaatatcaacagataatagtaaaacaaatgtaatatcaacagataatagtaaaacaaatacaatatcaacagataatgataatgcagatacaatattaacagataatgataataatacagatataatattaacagataataataatacagatacaatatcaacagataatgataatgcagatacaaaagcaacagataataataataatacaaatacaaaagcaacagataataataatacaaaaataatatcaccagataataataatacaaaaacaacatcaacagataataataataatacaaatacaaaagcaacagataataataatacaaaaacaatatcaaacgataataataatacaaaaacaatatcaacagataataataatacaaaaacaatatcaaacgataataataatacaaatacaatatcaacagataataataataataatacaaaccaatatgtctttgctaacaattataatgaaacaacttctgatgatgaactaaataaagattcctgtgattattcagaagaaaaagaaaatataaaatcaatgattaacgcttatttagacaagttagatttagaaactgttcgtaaaatacattcagatataagtacatgtattgaaaaaaaaaataatcctaggaatcaaataacacatttaaacaatttaaaaaatatgtataatataattaaatttatagtggttatatatattgcttttaattggagtgaagtaatatataaatatgtaggaaaattaattttagcttttgctttatatatgttaattaattaa

SEQ ID NO: 173 - DNA, 288 bp, Plasmodium falciparum
atgagtcaaccacaaaaacaacaaaacgaagaaggagccgccactgccgccaatacccaagaaaagaaattcaacccaacaagaaacccaagccaatctggtccctatcgtcatcatggaccccaaggaagaacaccatatatgcaactccacaaaaatcaaaataataacatggtaaataaaataagtaattatttaggaattgaaaacaaggagttggttgaatttggtttaaacttattcacatatattatagctatatttcttgccttacaaatatatgattac

SEQ ID NO: 174 - DNA, 2820 bp, Plasmodium falciparum
atggagaagaatacgtacgatatggaaaagaataaatacgatatagaggtttcagaaaacaatcgttttctttttaacaaacaaagagattggcctagaataacttttacctttttagtattcgtgttaggaataaaaaccgttttgtgtatattattatatatgtataataatatattattatttgtggtgtttttaatattatgtgtggtttctttttatggtcttatagttaatacaattaaatctctcgtattatatatattaatattaagcttagtattaacaagtattagcctgtctttttataatatcatatatatagaatatatatctaaagtttttgagcatgcatttctttcgacagtattatattctacgttccctttattggtaatggaattatttgtaagtatagcatatacatgtttaaaaaaaaaaaaaaaaggatatatagaaaagcaactaaaggaattaaaaattgccatagataatacaaatgaagaaaaggacaaaaaaaatgaaggaaaacttttatcattacaaatcgatttagaaaagaatcagctaaacacatgtaataaagaatacaaatattatttaactcattataaaaataaaaaatatatatgcatagaaaaaaaaacagactattctagtgaagatgaaatatatgctaaatatatacaagacaaaagtagcgacaacagctatcaaggatatgataagtcaaaattaattaacacaagtaatattaatatgttaaatgtaaaaacaaataaaaaaaacgtaaatcattccatgtcatcaaatactattcaacaagatttgagttttatacactccagtataaacaaatatgaaaaaaaaaaagaaaaagaaaataaaaattatgacaaaaataagaaaagcagcaatactaatgacaaaagttataacatcactcaaaatgatcctagaaaaaacaatcagaacaaagaatttgttgataataataacaaaagaaacgatcataataaaaataatgaacttgaacaagtatattataacaatccaaatgttcatcagaacaattatcagcttagcaagaacaaaatgaataccacagaattacaacatgataatttatttaataaaataaatccattatcatcagataatacatcgtcaattatattaaatagtaataatatgaataaatctattaataaagatacgtatgttaatatgtacgaaaaacacgaaaaacctctcatggtcataacacaaaaagaagaaaatcttaagaaagataatgtcctgaacacatccttatccagtaataatgaacaaaattgtattattgaaaattttatagaaaaaaatataaatattcaaaggaaagacaacattctatataattcattgtttcaaaaacaaaatcaaggagacaacatcaaaaaggatcaaaaaaataatcaagccaatgaaattatggaaaataatgttacgcctaataatttgtacacaaatattattaccatccctctaccaaaagagaatcaaaataaaacagaagaaaaaacaaaaatagaaaattacaaaattggtctcacctatgatataaccaaacaagaacaaatacataattatgttacaaatctaaatgaagtaagtcaacatgagaagaaggaagaaaatcaaatcgaagatatgaacataaacaaaaatatagaacacaggaataattttatcacccatacaaataataacttaaatattgatgaagatacaaaaaaaatgcaaaaggatatattttcagcttttttaaaaaataaggaagatcaacaaataatggatatcaaaagtaaaaatgataacatggaaattaagagggataacatcaaaagtaaaaatgataatatagaaattaagaaggataacatcaaaggtaaaaatgataacatggaaattaagagggataacatcaaaggtaaaaatgataacatggaaattaagagggataacatcgaaagtaaaaaggataatatggataatatgaaaaatcagatcaacataaaaaccgaacacgtaaaagataatattaataagaataattttttggtaacatcaaaagagaaggaacataatatagatacatccttgaataaacatcatgttttggataacataaataattgtcataattttaataatacgaatttattaaatagtaaaacattcatagaaaaggatatatttcaaaataataatatatttaatgaaggaaaaaatataaaagaaaaggatatacaaaatattaaaaaaagtcaagaaaaagaaattaataatgaacatactaattcaaatatatttacaaatcctttacaagaagcaacaaaatatttggaagaaaaaaataaaaaaatggagtattctcaaaaatttccattctttctaaattttacaaataatataacgtctaataaagataacaaagaacaacaaaataaaaattacaacaacgataataataatgataataatgataataataataatgataataataatgataaaaataataacaaaagtaatacatatgaccatttaactagttccccttcaacaaaaaatattttcttttcaaataatacattcttaaatatcaaagaacacaaagatgatatttataaagaacaaaaacaagaaaataataaaaacgcaaaaaaaataaaaacatttaattccgaaccatattggaaaagactagaaaaaaaagatattgaagaattcaaacattctgttaataaaagctatatggaaaatatatctattgac

SEQ ID NO: 175 - DNA, 1572 bp, Plasmodium falciparum
aatggacaagaacatattttaccaaataatcatgatatttatggccataataataaaaatgatacatatatgaacaatgcaagtttttgtgtaaatactcttaacgaagaaaatattaagataaagaaaagatatgtaaaagatatatccatatataacttttgttgtgatgacaagtataagggatgtaatttatatcttcatattgctaaaacgaaaaaactgaaaaattgtaaaatgaattataatattccgtatgagcactttttagaaaattatgatataataaaaatgtacgaaattaaaaaggacaaagggaatgatgataaaaggaatgataatgtgaagaatgatgatgaaatgaataaccatgtgacgaatgatgatgaaatgaataaccatgtgacgaatgatgatgaaatgaataatcatgtgaagaatgatgatgaaatgaataatcatgtgaagaatgatgatgaaatgaataaccatgtgacgaatgatgatgaaatgaataatcatgtgaagaatgatgatgaaatgaataatcatgtgaagaatgatgatgaaatgaataatcatgtgaagaatgatgatgaaatgaataatcatgtaacgaatgatgatgaaatgaataatcatgcgaagaatgatgatgaacaaattaactgtcgagaaaaaatgaatagtgataaccaaataaataagggagagaagaaaagaaacctcatagggaaactgtttgaaatagaaaaagactggaaaataaatatcgatatgcatatagatatagagaaattaataaaggaatataaaaagtgtaataatagaaacgaggaaatacacattagtgataataatcttacggatgataaaaatgaacaaaaatataagtctaataaattacattatatgatatataacttttataaaaatttcgattgtttaatgaatttaataaatagattaaaaaacaattcgattaaatatgaatattatttccctaaaatgattggtgatgttaatgaagagatacgaaaacattatgataagaaaaaagttatattattaaaaaagagtaatattaaatatattagggtatttaataatgaagtcaaaaggattatgattctattttttgtatcttataattcgaagatcttagatttagcttgtggacatggacaagatatgttaaaatataatagtgtacaaaataaagtgtatgtaggtattgatttatcaaaaaaggaaatcgaattagcaaaagaaagattaaatcaaaatgatatgaaaggcttatgtaataatgacaattttatttttttacaaggtgatattttaaataataaattttataggaaatggaaaagtaaaaatataatgttcgatattatttctattaatttggctttacattatgttatatataatgaaaagtcgtcaaaaaagtttttcaaaattattgaaaattttttagaaaatgatggattgcttttagcaaccactatatctactgtaacgttgactgactttctaatgaagcgatcgaatattgaaatgaatggagat

SEQ ID NO: 176 - DNA, 807 bp, Plasmodium falciparum
atcaccgaattactccgattccaaacctcaaaatcaggagacgaaatgatcggattaaaagaatacgtagacagaatgaaggaaaaccaaaaggatatttactatatcaccggtgaatccatcaatgctgtttctaattctccattcttagaagctttgaccaaaaaaggattcgaagttatttatatggttgatcctattgatgaatatgcagtacaacaattaaaagattttgatggtaagaaattgaaatgttgtaccaaagaaggtttagatattgatgattcagaagaagccaaaaaagatttcgaaaccttgaaagctgaatatgaaggattatgcaaagttattaaagacgtattacacgagaaagttgaaaaagttgttgtaggacaaagaattacagattctccatgtgtattagtcacatcagaatttggatggtccgcaaacatggaaagaattatgaaagctcaagcattaagagataattccatgactagctatatgttatccaaaaaaattatggaaatcaatgctcgtcacccaattatatcagcattaaaacaaaaagctgatgcagataaatcagataaaaccgttaaagatttaatctggttattatttgatacctctttattaacatctggttttgctcttgaagaaccaactaccttttctaaaagaatccacagaatgattaaattaggtttatcaatagatgaagaagaaaacaatgatatcgatttaccacctcttgaagaaactgtagatgcaaccgattctaaaatggaagaagttgactaa

SEQ ID NO: 177 - DNA, 1902 bp, Plasmodium falciparum
atgtttacttttcttgttattattgtaaacgtattggtttgcatatgtttcttaaatacaaaataccagattcaactggattatagtgtacctagtaccttaatcaatttagatagatctttaaaatatacgaacataacggtaggaaaagattcctttctttgtatattagataagtctgatagttttgatacatgtgagcaatatgatttattgaaagaggttgatgatttttaccctaatgggtttgacgaacataaagaaataaataataataataataataataaaaagaagaagagttataataataattataaaaataattataatcatatcagcaataatggtgacaatcaaattaataatgattatgatacaacctacaataggtatgattatatagaagaacatctaaataaaaactttcttctaaaatatcaagataataataatatgaactataatttatacctaaaggaagataactacgaaatcgaatatcataatgcacattactggatgaatgtccaagatgaaaatatacaagcaagcgatcttacacaaaatattattaaagatgttggtgataataatacaagttataagaacagtaataataacggttggacttgtaataacgtattgaataaattaaataataaatattccaaagaattaaagggggggaaaaaaaaaaaaaaaaaaaaaaaaaaaaaagataaaaaaaaaaaaaatcattatgattatttttcgaacgaaagaaacgaaaaagttgataaattaaataagacatttaattgtaattttaaaaggttatatgattatattttttataaacataaaattaatgcgtatcataaatatagaatatataataatattaatgatgacgtattattaaaaagtcatataataaaagggaaaatgttaaccataaataatacatgtattgatgcgtttaataatggaaatatattaaaaatatgtttaaataaatctatatcatttataacaaaaagatatcatacgaaacataaaaaacatatcactatatctacttatgctataggaaaagatttattattttctaataatactgttgtacaatattatagtgatggcaaatatttttttgaagtattatttttatgtggtaataataatttaagagttaatagttttgaaaagctgtataatgtatattatccattcattttccaaatatatgaacatttaaatacaactattactaaactttataatattataataaaaaaattaaaagataatgatgtatatttttttaaatcattttcgaattatcaatatactgaagattattataaatcattaaaacaaaaattaatacacaatttaaatttatattatcctgaagctatatatttatatcgtattacattaagtggatatatgttttgtaattatacagagaaaataaatccaccaaatttttttcttttaaaaaatctgatgaataaatgtcatcattttattagagaagatgataccatgtttgaaatatgtttaccatatagtgttatacaatataagaaaaatgcttatgggaaagaaaaatatccattagttttattaggatcatcatataattcacttaatcaaggtaaacccttttatgaaaaaatgtatgatatttttcctgtattaaaatctaatcatatgatgaaaaaaactatagaatattataataaattgaaaggaaacctatcaacatctaatcctttgcccacacaacaaaattcgctatcatctacaaatacgaataattcaaatatatcaaatgtaaaatatgattattcaaataaaaaaaaaaatttaacttcacctcaaatgttgtcatctttagaggaattttcttta

SEQ ID NO: 178 - DNA, 2652 bp, Plasmodium falciparum
aaggacaccacagaagacacagaacaggatgggcagggaccaccggtaaaaaaagacgaagtaaatccatgtgatatagtgtctaaactctttcagaacccaaacaatttttccgacgcttgtaccctcaaatatgttactggtaaaaactacggctggaaatgtgtatcaagtggtaacggtaccactagtagtgagggtcgttccccacgtgtcgcacgtagtgcccctagtggtgataaggacggcgctatatgtgtgccacccaggagacgacgattatatgtggggagattaacgaagtgggcggaaagcaaacaggtgacacaaccacaggaggatggtaaggcaccactagctcccactccgccgacctcgtcggggtcacagagtgacccgctccttaccgccttcgtggaatctgctgcaatagaaacttttttcttatggcataaatataaagtagataaaataagagaggaaaaagaacaacaagaactatttacaaatacatcaacccttggaaaagaacttcaagataaattagaacgtggtaacatacccaccgattttttgaggcaaatgttttatactttgggagattatagagatatattatttagtggtagtaaagacgcgaaaaatggtgtcaacgacatatttagtggtgataaagaaatgaaagaaaaagaagagaaaataaaaggtgcgatacaaacgttttttgaaaatggtgcttcccaacctcctagtggaaaacgaaatgataaacatgaagaatggtggaaaaaccacggtgaacatatatggaatggaatgatttgtgctctgacatacaaagacaatgacgccaaaggccaaacaccaacacaaattcaggaagtgcgtgacaatctttgggacagtggcaagaacgagccaaaaaaaccccaataccaataccaaactgccaaactcgaagaaaaaaacagtggtaccaaacctaccaaccaaaccccctcatccactagtgataacacccccaccaccctcaccgactttatatcacgccccccctacttccgataccttgaagaatggggtcaaaatttttgtaaagagaggaagaaaagattggcacaaataaaacatgagtgtatggatggtgatacacaaaagtatagtggggatggggaatattgtgaagaaatttttagtaagaaatataacgttctccaggatttaagttccagttgcgctaaaccttgtagattgtataaaacgtggatagaaaaaaaaaaaacagaatatgagaaacaaaaaaaggcatatgaagaacaaaaaagtaattacgaaaatgaacaaaaagacaaatgccaaacacaaagtaataataatgctaatgaattttctagaacactaggagcgtcccctacagctgcagcatttttaaataggttaggatcatgtaaaaatgataatgtagaggataatggagaggataaattagattttaacaatccagagcaaacatttagacctgcaacaaattgtggtccatgtcctgtaattggagttaaatgtaaaaatggtaattgcagtgatacttcaaatggaaatatgtgtaaaggaggaatgattactgcagaaaatattaacaattctactgatgatgtaagtatgcttgtgagtgataacagtacaacgggatttaatggtttagatgaggcttgtcaaggtgcaggtgtctttgaaggtattaaagaagataaatggaaatgtgggacggtatgtggtgtagatatatgtactctggaaaaaaaagatacgaatgggcaagaaggtgataaaaaatatatcacaatgaaagaattgcttaaacgatggctagaatatttttttgaagattataatagaattcaaaaaaaattaaagccatgtacgaaaagtgaaaataaatccacatgtataaaaggctgtgtagaaaaatggatagataaaaaaaaggaagaatggaaaaatataaacaataattaccttcaacaatataaatatgttggtaatactttaactaattttttagagattttgatacctaaaattgatctcacaaatgataaaaaaaagattaaggatttacctgcgttcctgaagttatatggatgtaattgcgctgataactcacaaaatagtacacaaaatgatgttgttctatgtttgcttgaaaatcttaaaacaaaagcaaaaaagtgtgaagagaaccacaaacctagtggcaaccaacaacaaccgtgtcaagaatccccctccgttgaagacgatgaagaggacttaacccttgaggaaacagaagaaaatacagaggaggcaaagaagaagatgatgccgacaatttgtgaaactgtggtaccaacagaaccagaagaacctggagagacttgtacaccagcagcagcaggtggtggccacaaccccgaacaaacccccgttctcaaacccgaagaagaagcaccaacaccagaagcggaaacaaaaaaagacaaagccccagtgaaacccccatcacaaccaacaaccccccaaatagtggataaaacccccgccctggtgacctccaccctcgcctggagcgttggcatcggttttgctgcgttcacttatttttttctaaag

SEQ ID NO: 179 - DNA, 1395 bp, Plasmodium falciparum
aaaaaaaccaaagcatctgttggaaatttattccaaatactgcaaatacccaaaagtgattatgatatacctacattgaaatccaaaaataggtacataccatatagaagtggtacatataaaggcaaaacatatatatatatggaaggagaaactagtggagatgacgataaatatgcatttatgtctgatactactgatataacctcttccgaaagtgaatatgaagaattagatattaatgatatatatgttcctggtagtcctaaatataaaacgttgattgaagtggtactagaacctagtggtaacaacacaacagctagtggtaaaaacacacctagtgatacacaaaatgatatacaaaatgatggtatacctagtagtaaaattacagataatgagtggaatacattgaaagatgattttatatctaatatgttacaaaatgaaccaaatgatataccaaatgattatagtagtggtgatattccattcaatacacaaccgaatactttatattttgataataatcaagaaaaaccttttattatgtctattcatgatagaaatttatatactggagaagaatataattataatgttaatatgagtactaaaaatgttgatattccaatgagtgataaaaatgatgtatacagtggtatagatttaattaatgattcgttgaatagtaataatgttgatatttatgatgaagttttgaaaagaaaagaaaatgaattatttggaacgaatcatccaaaacatactaatacacacagtgttaccaaatcaagtaatagtgatcctatagataatcaattgaatttgttccataaatggttagatagacatagagatatgtgtgaacagtggaataataaagaaaaagtattagataaattaaaagaagaatggaataaagataataatagtggtgacattcacacaagtgatagtaacaaaacgttgaatactgatgtttctatacaaatacatatggataatcctaaaccaaagaatgaatttaagaatatggatacaacccccaacaaatctactatggatactatgctggatgatctagaaaagtataacgaaccctactactatgatttttataaaaatgatatctattatgatgtaaatgatgatgataaaacatctatggataacaacaataaccttgtagataagaataaccctgtggatagtaacaactccacctataaccaccgcaaccctgcagacattaacaaaacttttgtggatataaacaatcataaccaacaccctatagaaaaacctaccaaaatacaaattgaaatgaattcaaataatcgcgaagtggtcgaacagcaatatcctatagcggatatatggaatatatga

SEQ ID NO: 180 - DNA, 2709 bp, Plasmodium falciparum
aacatggatatgaataatgtaaatatgaataatgtaaatatgaataatgttgatatgaataatgttgatatgaataatgttgatatgaataatattgatatgaataatattgatatgaataatattgatatgaataatattgatatgaataatattgatatgaataatattgatatgaataatattgatatgaataatattgatatgaataatattgatatgaataaggttgatattaataacgtcgatattaataatgtcgatattaataatgtcgatattaaccatattaatcgtaatataaacgacacaaatgttgaaaatattagtaataataatatggatattcaaattagtgttaataatgtggataataaaaatgctgatatgaatttaaatcatatggaaaaaaaaataatcgaaaatgatataaacaataatattataattaatgataatattattaataacaataataatattagtagtagtgaacatatgaacacaaattatgaaatgctggaaaagatgagtgctgttgaaaataatagttcattaaataaaacattaagagataataattttatgaattcaaatatacttaattttaatataaaaaataatacaaataatagtaatccttttaatatctcaaaggatataaatattttggaaaaacataatttagaaaggaataataatattttggaagaaactagtagtataaaaaatatgacaaataatgtaatattgaattgtaataaaaatataattgataaaaatattattagtaatacctttgataatgttacaagtgaaaacatctcaacattgcaaaagaattattatgaaaacgaaaaaaataacttgataaataatactattaataatgtaaacaataatattaatgatgataataaaaataaaaacatgcaaaattatgtacctgaaattgataacggttcctctttaattaattctccttatttttccaaccagtatgaaaatgttatgacacatatgtacgtagataaatcagttatgcaaaatgaaaactttaacaacatgggaaataataaatttagtatcataaacaaaatgaataatgtaatacatgacaaacaagtatataataataagagtaatgataataataataatagtaataatattaataataataataataatattaataataatattaataataatagtaacaataataataacaataataataccaacaataatatcaacaataatatcaacaataatatcaacaatatcaatagcaataataatactgttgttggtgaatacaatgaaaaaaattataaagatttatcattcgttacaaataacaatgaacatcatcatgatggttcagttattccaaataatttttgtaataattttagtatgtatgcaaatatgatgaatatccaaaatgttaatggtggtacgataaaaggtcatatatccacgacttttaaaacaaacttagatcatattgatcctaacaaaaatgaaatgagtgtatataaccaagtaaatgaatatgatgtaattaatgaatatgatgaaatgaatgaatataatgaaatgaatgattataacgaattaaatgaattacatgaaatttttgttcgttataatttcaattctgatagtgaagaaaaaccatgtttacatgaacgtacatgtaaaattaatgaatttattactgtatgtacaatatgtcatgattatatcaatgaaaatatggaatgtaaactagtttcatgtaataatattgaaagtgaagaaaatttaggtcataaattaaatgaggaggatgaagaactattagtacataataacaatataaataattatgaacaaatattagttgaaaaggaaaaaatagaaaatattcattttgatgaaaatatttatgaagctattccaatggaaaatcttaaaaacaaccttgatgatagtattccaaaaaataataatattgttaatacgaataacagtaataatgttgccttaaattattcaaataatgaaaatattgttaatagtagtagcataaataataataataatgacaataataataataataataatggagaccatgattgtttgatcacaaataatatttctattttagaaggaaatgaaggagatatgaattatatatataattcatatgaggaattttatattaacaataatactatggatgatatgaaaaataataataactatatgaataatctcttttatcaagaacataataattattcgacaactgctgataattttgcttctaaccaaactcctcttataaaacatcagaaattttattatgctgaaaatagtaataataattatcttagtgattctgcaaattatgtaaatggacaatctttctcaaacaatgatgaattatttaaaaatgattctttatatagtgataataattctcctttaattagtaacaataacaataataataatagtaataataataataataataataataataatagtagtgataatagtaataataatagtaatagtagtaataacagtattagtagtaatgctaacccaacgaataatgactgtaatgataattatcaggaaaattacgataactttattaaatcagaatgtaataataattcttgttacaatatagtacaaatttga

SEQ ID NO: 181 - DNA, 798 bp, Plasmodium falciparum
atgggacaagaggtatcgagtgttaacaacacaaaaaatgaacaccataaaacaaataagaaaagtttgaaagggggtaatgagagacatgaaatgaaagagagtagtgtaggtatatctaagaaaatcgtagagaatagttttaataatagtaaattaagacctggtatgtttatacagaatagtaatgttgtatttaatgaacaatataaaggaataaaaatattgggtaaaggttcttttggtgaggtgatacttagtagggataaacatactggtcatgagtatgcaataaaagttattagcaaaaaacatgttaaaagaaaaactgataaagaaagtttattaagagaagtagagttattaaaaatgttagatcatattaatataatgaaattatatgaattttttgaagataataattattattatttagtgtctgatgtatatacaggaggagaattatttgatgaaattattagtagaaagagattttatgaaatagatgcagcaagaattattaaacaaattttaagtggaattacatatatgcataaaaataatgttgttcatagagatttaaaaccagaaaatattttattagaaactaaaaataaagaagatatgataattaaaattatcgactttggattatctacacattttgaatatagtaaaaaaatgaaagacaaaataggaactgcttattatattgctccagatgtattacatggtacatacgacgaaaaatgtgatatctggtcatgtggagtgatcctctacatacttctctcaggg

SEQ ID NO: 182 - DNA, 1404 bp, Plasmodium falciparum
atgaataagttattgcttttttgtcttttcctatacagcgtcgtagctgtaagaccctacaaggaacgttatggtaatgtttccaagcatttagataacgagtttaagaagaggaaccctgatggaggtaaaccattcaatttaaaagaaaatattaattatgtaagaaaaaataattatgagttgtacgttgatgccaatggagaattaaaacaacagaattataatgtgaatgaaccaagacaagttttaaaaaaaaatatggataaatttcgttatttaataaacgatttagaagtattatttggtgtgtatgaattaaatgctagagataaagaaaaggtattaagagagactttaaaaaaagaatctttatgctttactattgctggattagtatcaaatagtcttaaccaaataaatgttgaggattctccaatatatggattattgatacaaggagaaagagatagaaattatgaagtaaataatacacttgatatatatgtgatattatcaaatataagtgttcctttaggtagtttttttttcccagaaatgaaaagagctccatatcaactaccatatttagttggtcattatgatagtagaagtggaattaaaaataagagtatatcttatttatgtccattacctgaatttttaatagatgtaatgagaacaactaaatatggattaaaatttaattttaatggtactgatctggatgtaaaggaacttttccctgtgactttaacaaatacactagaaacagctagtctcttacctgttcaaaaagaagattcgtataagaatgagcgtaacgtgttattaggtatattacaaaatatatcaaaagatataccatatagaaaggttgtagatagaggagtacaaggtaatggtattattaaccctgaagaaagaatattagcaagtaaatccttttctagttctcgtgaaaatattaaaaattttgtatcgaattctggtaaaagttcattagatacaagttctatggctttatactttttagcattaagtcaaaatttatttgaacgaactagaaatgcagtaccatctagtaatagattaactaatataactgtcacaaatgttcaaacaaataatgctggatatttaacacactatactctaaaattaggtttagaaaattcaagatcattaacagtagaaggtttagttaacgggaaaaatatatttgtacctaaaggtatacaaaatattgaaaccgtggtatcatatgatgtaccatatacatggggtattatggtaagtcctcaagaaggattttcatatatctttggaaacttggtttttgacattgcaaaatctttttcttataatgtaaacaacttatcctcatttgtaaggagtccatag

SEQ ID NO: 183 - DNA, 840 bp, Plasmodium falciparum
ggtatgattttaatgtccgaactatccaaaagaagattcagaagtgtgaacaaattaatacgtgtaggtaggcatgaggttgtacttgtattaagagtagatagccaaaaaggatatatcgatttatcaaaaaggagagtatcaccaaaagatataataaaatgtgaagaaaaattttctaaatctaaaaaggtgcaccagactgtgcgacatgtagcaaaagaacatggcattactgtagaagagctaaacgaaaaagctatatggccattatatgaaagatatggacatgctttagatgcgttgaaagaagctacgatgaatccagaaaatgtatttaaagggttagatatatctgaagaaataaaaaattcattattaaaagatattaaattaagacttactcctcaagcattaaaattaagaggtagaatagatgtatggtgttttggatatgaaggtattgatgctgttaaggaagctctgaaaaaaggaaaagagatatcgaatgataaagtttctattaatataaaattaattgctccaccacaatatgttattgttacgtcttgtcatgataaagatcttggtatggcaaaaattcaagaagctatgaaagttataagtgataaaatcaaagaatataaaggaggtgattttaaacaacaaggagaaattttagttatcggaggtgatgaagaaaaacgtttagaagaattattagataaacatgatggaatttcaagtgatgatgatgattataatacaagtgatgaagatgacgaaaattcaagtgaagaagacgaaaatactagtgaagacgaggaggaggaagattaa

SEQ ID NO: 184 - DNA, 2028 bp, Plasmodium falciparum
atggtgttagtagtagagtatcataatataaatactcctgttggaaaatattcagagttggagaatttgaaagaagaaaaggaaaaaagattatataataatttggaatatgtaaatttattagacataagaactttggaaaataaatctatatatgtatcttcagatttattgaattttttaaaatgctattcaaatttgaatatcaacttgaataaggttccttatgatttggtctattcatttttgcttgatggagaattatatttaggatatgatatatctgtttttattttattagtaaaagcagaacattttgaatattgtagaagaatagataatgaaaatagtgataagaaagaaagttttagaacaaaaaataaatcaacaattaaaagatcatcacagatagatgatgaagataatttacaaggattgttgattaaagaaaaagaagattatttatcatttttgaatgaaaataatgaggctttaaaacaatatatggaatccgaaaaaagaggaaatcctttgtggcatttggatgaatctaaatatatggataaagattggtatgatgaagaagattcatcatttatatttaagcctacttttaattatttaggaaagaataataataataataataatcataataataataatgctttttctaattttgtaatgggcaacttatcttctgataatatttctggatgcttctttgtggagaaattaaatgcttatcttttcgccatgttggataaatgtagcaataaaacagttatatctgtttttccatatgaaaaatttggaagacacgaatccagaaatttagctatccaattttcccaatatgaggactatatgcataggataattgaggacagactttatgcgaatattcaaaataatctcccaagtgttcacaatatgaagaatatgagtaatatgaataatataaacaataataataaagatattattattaatagaagtggtatttctaatggtaatagccaaagtgttccttgctttgaaaatattttggattatgataaattaaaatttgtggaatatataaattcctttagtgatgtaaagaaatcatcttcattcgatattattggtagcagcaaaaatatatatgaacaaggtgaaaacctgaagaactattgtatatatcataataataattttgaaagtggatttgaaaattatattttggaaaataaacaaccattggaattaattgaaaatcatttcgacataatggaaaacattaaagggatgtatgataatacaaatcaggaggaaatgaatttcaataatgtttcagggttgttgagggaagacaattcaaatatgaatgaaatatacctaacgagggataatcataataataattatcatgaaaatgaagaaaatatatatagtattaatattaaatatattaataatcattttaataataaggatgatatgattatgaaatgtaaaaatatgaagggatctatttctatggataataatagtagtaatagtaatagtaataatactcattttgagaaaacattggaatccataaatcctgatgaccataatatttttaacagtgaaatggattctatgaaaaatgaaaataacgatgaagaagaacaaacagccacaagtatttataacattttaggaaagattggaaaagatacatatattaaaagatgtagtagtaattataactatgataacaataatggatatagtaacgaaagtagtgacaattataataatgggtataatgatagtacagataataataatggatataatagtaatagtagctataatagtaataataatgaagatgataataacaataataataataatgatgagaattgtgataataataataaccataataataataattataataataataataattatggtaacaataataataacaacaataataataaggacaataataataatgatggaaatggtagtagtaataataat

SEQ ID NO: 185 - DNA, 2022 bp, Plasmodium falciparum
aataataataaggacaataataataatgatggaaatggtagtagtaataataataataatgatgatgatgacgaagaagaagaggatgatgaagatgataacaataataataatgatgatgataatatgagtgataacgaagaaatggaagataatgatgaagataacgatgagtataataatagtaatgatagttataaatatgaagaaaaagatagtaatcatgaaaaggatttgaaaaaagatataatagaaggagatatgattaattctgttaaatatgataaaaacattggtcatcatactacaaataagagtgaaattagtactaactattttgagaacagttgtaacatgagtgtaaataatagtaataacgaagcatatgatgataattgtaataatggttttatgaatcatgacgaaggattaactcttaataatgggaatgtttcaaataataaatgcgatattataataccagaagatggaagtgttatgtatgaaaatatgattaacagaggaaacggtcttacaagtaacattaacaataataataatgtaagtaataataatagtataagttgcaatgcagatgataatgtatataataatataaataattatataaacacatatatggaaactacaaacaataagaatcatattgagaatagatgtaatcaagattcatacagtacgaatgaagaacctttatccaatcattctataaatgatccaggaaaaataaaagatggcataatgtatgatggaaatgatttggatatgaatggtacccaagaacatagtaaagaagaagggatggatgtttttgaacctaattttttcgaattaaaaagaaatagttcggatggtcaaaataaacatttagaaccaggagttcaaaagaaaattagtaaaaaaagaagtaaagtgaaacatgaaagaaatagtaaaatacttgatgatgaaaagaaagaagtattaaataaagtatctcaaataacacgagttggaggtgtttgttttgataagaatagacaaagatggattgcacattggaaaattgacggaaaatatcataaacattatttccctattagtcaatatggatttgaaaatgctcgagaaagagcagttagttgtaggaaacaagctgaaaaactatttaacttaccagaaattcaaccaagaaatagatggaatcaaataaaagtcaatggtacttctcacataaaaaaagctgcaaaattaccaagatgtgaaggtattggatatgatgaattgtctcaaagttgggttagtacttttgttgttcataaaaaattttctattgaagaacttggattttatgaagcaagggaaaaagctatatattgtagaaaaacatttgaaaaggtaaatgttcatgatgattatgaatgtttattaaatgaccgattaggtttacgtaatgaggaaaaagatgaattatctgatctaattaatatagataaaaatgcattggataatctagaactggaaacatctgttcataataataataaagtgaaacataataataacaacaacaacaacaataataataataataataataataataataataattctgaaaaaatgagaattaaaaataatgatttttcagttgataataataatgaaaatgttggaacaggagaaattaaaatatccaatgataaatatttaaaaataacacaagaagctattgaaatgattctaagtaatatcaaacataaatccttaccagaaattaaaatgaaattaattgataaacaaaagtttgaaaattataatacattactagataaacattttaaatttattacatctgtaaaaaacatttcacagttaagacgatatatatcactctttcacaaatttataatttatcatacacttcctcataatatttctttaaggaaacaattatttattatcgaagctttagaatggtcttcgtttttttcaggtgcagctagcgaaaaagtggaataa

SEQ ID NO: 186 - DNA, 2157 bp, Plasmodium falciparum
tctataaaaccagaagtttatttaaagaaatactcggaaaaatgttctaacctaaatttcgaagatgaatttaaggaagaattacattcagattataaaaataaatgtacgatgtgtccagaagtaaaggatgtaccaatttctataataagaaataatgaacaaacttcgcaagaagcagttcctgaggaaagcactgaaatagcacacagaacggaaactcgtacggatgaacgaaaaaatcaggaaccagcaaataaggatttaaagaatccacaacaaagtgtaggagagaacggaactaaagatttattacaagaagatttaggaggatcacgaagtgaagacgaagtgacacaagaatttggagtaaatcatggaatacctaagggtgaggatcaaacgttaggaaaatctgacgccattccaaacataggcgaacccgaaacgggaatttccactacagaagaaagtagacatgaagaaggccacaataaacaagcattgtctacttcagtcgatgagcctgaattatctgatacacttcaattgcatgaagatactaaagaaaatgataaactacccctagaatcatctacaatcacatctcctacggaaagtggaagttctgatacagaggaaactccatctatctctgaaggaccaaaaggaaatgaacaaaaaaaacgtgatgacgatagtttgagtaaaataagtgtatcaccagaaaattcaagacctgaaactgatgctaaagatacttctaacttgttaaaattaaaaggagatgttgatattagtatgcctaaagcagttattgggagcagtcctaatgataatataaatgttactgaacaaggggataatatttccggggtgaattctaaacctttatctgatgatgtacgtccagataaaaatcatgaagaggtgaaagaacatactagtaattctgataatgttcaacagtctggaggaattgttaatatgaatgttgagaaagaactaaaagatactttagaaaatccttctagtagcttggatgaaggaaaagcacatgaagaattatcagaaccaaatctaagcagtgaccaagatatgtctaatacacctggacctttggataacaccagtgaagaaactacagaaagaattagtaataatgaatataaagttaacgagagggaaggtgagagaacgcttactaaggaatatgaagatattgttttgaaaagtcatatgaatagagaatcagacgatggtgaattatatgacgaaaattcagacttatctactgtaaatgatgaatcagaagacgctgaagcaaaaatgaaaggaaatgatacatctgaaatgtcgcataatagtagtcaacatattgagagtgatcaacagaaaaacgatatgaaaactgttggtgatttgggaaccacacatgtacaaaacgaaattagtgttcctgttacaggagaaattgatgaaaaattaagggaaagtaaagaatcaaaaattcataaggctgaagaggaaagattaagtcatacagatatacataaaattaatcctgaagatagaaatagtaatacattacatttaaaagatataagaaatgaggaaaacgaaagacacttaactaatcaaaacattaatattagtcaagaaagggatttgcaaaaacatggattccataccatgaataatctacatggagatggagtttccgaaagaagtcaaattaatcatagtcatcatggaaacagacaagatcgggggggaaattctgggaatgttttaaatatgagatctaataataataattttaataatattccaagtagatataatttatatgataaaaaattagatttagatctttatgaaaacagaaatgatagtacaacaaaagaattaataaagaaattagcagaaataaataaatgtgagaacgaaatttctgtaaaatattgtgaccatatgattcatgaagaaatcccattaaaaacatgcactaaagaaaaaacaagaaatctgtgttgtgcagtatcagattactgtatgagctattttacatatgattcagaggaatattataattgtacgaaaagggaatttgatgatccatcttatacatgtttcagaaaggaggctttttcaagt

SEQ ID NO: 187 - DNA, 2436 bp, Plasmodium falciparum
atgaatatttcatttacggtgtgtagcttatttatattactaattaatgttgttttacatggagcgcaaaagaattctgaaaaaaatgtatacacggaaatatgtgaaaagccagcgaatggaaatgaatcaagtgtatactgtatgaaagattacaaaaagaaaagttctttatatggttataaacatattatgaatttcttattaggaaatctaaataaacataaaaataatatagcagtagtggaacatgataatggtgaaccaaacaattatttgacttataatgatttttttaaaaaagttttatgttttagtaatacattgaatacttatgaaggaaaaggtattgaagaaaaaatgtataaaaaagaagaaaaaaataatggtaaatttagattgttgggtttgtatggtagtaattcaataaattggatagccgctgatatggcttctatgcttagtggtgttacaacattagttatgcactccaaatttagtttagatgtaattgtagatatactaaaggaaaccgaattagaatggttatgtttggatttagaattggttgaagggttattagctcatagaaatgaatttccacacttgaaaaatcttataatattagatacattaaataaatcaaataaaataaattctaaaggtttagaaaaaagtgataaaaacaaaaaatctaaggaaaaagataatggtttagttaatgttgattatgataaagaaaaattaaaaaaaataaaagatttaaaagtaaaagctagaagtgttggaataaatattatggaatttgatgagatgtcaagaaaagaacctaaaaaaataaaaataaataatgaagaccctaattttattgcttcaattgtatatacatctggaacatcaggaaaaccaaaaggtgttatgttaagtaatgaaaattttcacaatactgtagtaccattatgtgatcataatataataaaagaatataatcccaaaacacatttttcttatttaccagtatcgcacatatatgagagagttcttgttcatatcttattcatgttaggtggaactataaatatatggagtaaagatataaataatttctctaaagatttattaaattctaaaggtgaagtactagcaggtgttcctaaagtttttaatagaatttataccaatattatgacagaaataagtaatttacccccttttaagagatggttagtaaaacgtattatatctatgcgtaaggctaataataatggaagttttagtcaatttcttgaaggactttttaaaatttcttcaaaaattaaagacaaagtaaacacgaatttacaagttatattaaatggtggtggaaagttatcacccaaaattgctaatgagttaagtgttttattaaatataaattattaccaaggatatggtttaacagaatccactggtcctatttttgtgcaagatactagtgataacaatagtgaaagtatgggaatacctttttctccaaatacaaagtttaaagtaaaaacatgggaaacttataaagccaccgatgctttaccaaaaggggaattactgattaagagtggttctatatttagtggatactttttggaaaaagaaaatacagataaatcttttactgaagatggttattttaaaacaggggatgtggttcaagttaatagtgatggttcattaacatttttagatagatctaaggggttagttaaattatcacaaggtgagtatatcgaaacagatttgttgaataatctttattcacaaattagttttataaataattgtgttgtatatggtgatgattcaatggatggaccactaggtattctttctgtggataaatatttattatatagatctttaaaagatgaccatatgttagaaaaaactggaattactgaagataattataatgatagattaaatgatgaagatataaatcaatctatttttgttgaatatgtcaaagagaaaatgatggaaacttataatagtacaaaattaaatagatataacataataaatcatatttatttaacatctaaaatatgggatactaataattatcttacacccacattaaaggtgaaaagattctatgtatttaaggattataactttttcattgaagaagttaaaaaaacatataaacacaaattaaaaggagttgatgaagtcaacaaaaataaggaaaaaaaagaagagaagaagaatgaaaaaaataaaaaccaaaaaaatgaagagcaaaattcaaaagatatacataccaaaaacgcagttcagcaatcgaagttaaggcccacaaaagaaaattttacagaaaagaaagaagaaaaagaaaagaatacaaaattaagagtacgagctaaagatatgtcccaagaattagaattaaataaataa

SEQ ID NO: 188 - DNA, 819 bp, Plasmodium falciparum
atggaaagaatattatcttctataggaaaattaagtgttgtagcaggggggctaagtttaattccatatacatttatatatgatgtagatggaggggaaagatgtgtaatgtttaatcgttttggaggtgtgagcgaaaatacatttggtgaggggagtcatttttatgtgccttggtttcaaacaccatacatatatgatataaaaatgaaacctaaagtaataaataccacaacaggtactcgtgatttacaaattgtaacaataagtttgagattattatttagacctcatacacaacatttaccatatttacatagtaccctaggacctgattatgatgaaagagttttaccttctataggaaatgaagtacttaaagctgttgtggcaaaatataatgcagaatctttattaacgcaaagagataaaatatcaaaagaaatacgagaaagtataacagcaagggccaaacattttaacattttattagatgatgtagctattacacatttaagttatggtaaagaatttgctaaagctatcgaagataaacaagttgctcagcaagaaagtgaaagagtaaaatttatagtagccaaaacggaacaagaaaaaattgcggctgttattaaagcacaaggtgaagcagaagcagccaaattaatttcatcagctgttaaagaatacggtaaaagtttaatagaaataaggaaattagaagctgctaaagaaattgctgaaaatttaagtaaatcaaaaaatgtaacttattttccatccaattcgaatattttgttaaatcctagggatttttaa

SEQ ID NO: 189 - DNA, 2121 bp, Plasmodium falciparum
gcatttgaagtagtatgtagagatgatgagatgaaagaaaataaaaatgtaaaggaatatattaatgataataaaaaggaagaacataatcattataataaaaaggaagaacataataattataataaaaaggaagaacataataattataataaaaaggacgaacataacaattataataaaaaggaagaacataatatttattgtgataattcttctaattatcataatagaaagattacctttttcgatacgccaggacattccgtattcagaactataaggaaacgatgtgtacaatgtagtgatttgatcgtattagtaatttccttagatgacggaattatgagtgaaaccattgaatgtattgaactagccaaaacgtacaatacaccacttattatagctgcaaataaaattgataaatttcataaaaatattgaagagctttcaaaaagtttattaaattataatatcgttactaatttagaaaatggggatgttcccatggttccaatatctgccaaaaaaaatataaatattgatattttaaaaaagcaaattttacatgttagtaataaattaaatttaatgtgtgattatggatctttatgttcagcttatatattagaaaaaaaagtggacccttctaaagggaaattattaactgttatatgtaaatctggaacattaaaagttaatacatattttataattggacatatatatggaaagatcaaaagaatatataatagtaataatgaaatagtatcacaagcatatccttcagaagttgtacaaatcataagttcaattcctttatcatatgataatataaattatggtgatattatgttagaaatgaatactttgaaatctgctcaaaaagtatctaaatataagttaaaattagttcaatataatttaataaatgatcattataatatgaacaatactttaggtgaaatatctagaaatatcgaaacaaataaaaataatgatattcataataatgataataatttagatgataacattatcgatgaattacataatgatatatctatatatgatggtaataaaaaaaaaaaaaattctaacaaattggatattaataaaaaatataacaataataataaaaaatataacaataataataataataataatatatataataataatatatataataataataatatatataatatatataataataataataataaatattacaataatcatagtaacgatttaaggaatccattaaataagttcaatagcaagaataataatttgagtggttctaattttaatttaaattctttcaagttaccgcaaatacctttaattttaaaaacatgcgatgaaggtagtttagaaggtataatggaaggaatagaacattttaacaaaaatgagactaaagaaaaatattgtaatatacataattttatagataggaattatataaataagaatatgttaaatgatgatataaataatatatctaaagaattattttcaaattggtgtcctttaaaaattataaataaaggattaggtacatttcatagtacagatttaaaatattgtgaacatataaatccatgctttcttatttcatttaatgttgatattgattttaaattattacaaccatatatagaaaatcataatattattttaagaaatcataatattatatatgaattatttaatgatatagaaaatatgtgtaacttttattttgattctttacatgtctatgaaccagtcgcaaaaatgattataaataaaactgggtattattctattaaaaaaaataaaacaaaaaaagttgttatatccgttgatataaaagaaggatcatttacatccaatgaatattttacacttaaaagaaataaacaaattattcataataaaatacatatactttctatgcaaaaaaataaacaaaatacaaacgagctaaacaaatcatgtaatattaacgccatcatatttaatattaattctgatgattttgaggtaggcgatgaaattgtggcttacaaaaaggttgtaaggtcccccctctttaacacaataaaatcatttgacctttcataa

SEQ ID NO: 190 - DNA, 2019 bp, Plasmodium falciparum
atggtggataaaattaaagaagatgctattattcaaaacacttttcagatatgcttgaaaaaagaggaatgtaataataacaaattatatttagaatcttatgtgaaagaattaaaagaaaacaatgaggagttatattttttgcttgataatttatattttattttacttcacaagataagtgatttacatagacagaagaaaaattgcttaagttatttatgttcatgtgcttctcggttagttgataaaagtttatataaaggtataaatatgaataataaagaaagtgatataataattaatgagatatctgatcaaattgttaatagtgtaattatatatttagaaaatttggatatatatccaaatatgaaaataagtaaaaaagaaagaatggaagtattttatgaatttttaaaaaaatcttgtacatctcgatttttaaaaaaattattgtcttttatagaagaaaacgataaaaatgaagatgatgaaaatagtaaacagttaaataaattctttaatccaataatagatttgatattaagtaatttgaataatagaaatttagtgtatccaaaaaatgatgtcgctgttttgttcagtttcttgacaggtttcaaacctatagctgatttgataacacataataagtctatgtttttatatataaatgtgaatgatcgtatgaaggataatatgaattgtgatataaaaaaggaaagtgataaaaatttattatcaacatgtaagagtatgcctgtaaatacgaccgattcgtctacaaataatataacaacaaatcgtagtaataacagcaatggtaataatgatgttccacaagagggacccacaaccaccaactctaataataataatgcaaataataaccttagtaataataaccttagtagtaataatcttagtaataataatcttagtagtaatagcatcatccgtagaagcgtgccatacgcacatttccatagcaccattatacaaaatagttattcgcgatttagtagagataaagaaattagtacttgtggatacaacttccaattgaatagcttactaggtcgtctaatttcacctacaattattaatatgcccaatatactaaaaaaagaggagattgctatgtataaatatttctttaacagtaatacaaatagtttaaataaaatgacactaaatggattaaaaaatacttatactttattaagaaaggatactgattggattttagaaaattgtgtagaaattataaagaacttattaaaaagtagtagtgatagtaaaaagataatattgctatggataaattgtattcttatctctaatgagaagaaaacaaaaataatgtatcattattctacatatccacaatcattagatacttcttatggattatttttaaaattgttaggagaaaattcttatgggttttgtcttaatatgttttgggttttattatgtttatgtgaacccataactgtaaataaaattaacgatttggatttttttttctttctaagaaatgacccgttctctaaatttttattaaaaaatattacaaaccaatcgtcgtttgaagataaatcaaatgtcgaaaaaattaagaaaaatgttgaacgttccgaatgtttccaaaaagagcctaaatttatcacatgtatattttggatgacctttaaatcattgagtgtattttttaaacctgccgtagatgaatttattaaaatagttcaagaagcggggaatgccaaagataaagatttttattatatgaatatacatgcgtggaaaattttcctgtataacacacgctttaatcaattattgtttaaatttttacatttatgtatgaattattttcttcatgtagcatatgtatatgatattaatggaaatattaataattctatgaaaacttgtttaaatgaacataataatagtttagtacatttggttttaaagtgttgtcctcctcctaacgagaaatattataataat

SEQ ID NO: 191 - DNA, 2016 bp, Plasmodium falciparum
gtacatttggttttaaagtgttgtcctcctcctaacgagaaatattataataatactaaagaaggtacaaccgaggggactaatatagtttcccacatgagggaaaatgaaaaagtggaaaggaatgaacctattggagaaaataaaagaattgaaaataatgatggggttgtcgaaaataaccaaatgaatgaatcaggaagaaatggttccctagatgaagaccttaatagagacgaaagagaaggaatcaacataagtaatgaaagtaataatagggtatcattaggtataaataataacgaagagaataccccaatggtgataagtcctttggatggatcagatgatcgtttatatgcatctccacacttttctataatacctactttttttttaagtgatatatttgaaattttatatttattatacgaattggatttatttaaaagtccgaataatgaaacattaatgaattatttagatatagatttgtttttagccttttctatatttacaatgttaagtgaaaatcatattaaaagtattcatttaagatgtgaatcagctcctaaaacattttcatttttatataaattagataatttaaaaaaagtaattgaagaatctgaattgactaaaaaatatataataaaatcattaacaaatgtatttatagcttcacaaaaaggagaatacacggaaagaatgcaaacacgtgtacgtatagtagagaactttaatagtttctttttaaataaaacatatgtaaatcaatttacacaattagtaataaataataataatttatttgttcacttgatacatttattattaaatgatgtaagttttctagttgaagaggttgtgtcttatttatctgaaataaaaagaagagaagaaaataataagaagaaaaaggattcccaacaagaaaatgaacaagaagcaaattcaaattcttatttaaatgcgactacaagaaataatagaacatcaaatggaagtagcaattctgtagcaaatttaaattattcatctttaaataataataataataataacaataataacaataataataataacaataataataataacaatagtaacaattttaatgattcctcatttaatagtgataataatagtgatgatggagaagacggtggaatggattatgatttatcaaatgaaagtatgagaaacctagcagccaaaacaaaaatgattataacatattgctataagtcatgtatatttttaaatttattatgtaaaaattatccaaataatatacttacatccaataccatactatcacaaatcgttacatgcttaaactgttattttgattatttagttggtcccaaatgtttaaatatcaaagtaaaaaatatggaacaatataattttagaccacaattatggctcaccagtatagtagaatcttatctattcttattgaattctgataaagaacacgaagagttgttaattagagaaatagcaaatgaaggaagatattataaagctgaaatttttaataaagcttattatatatgtaaaagagaaggattgttacacaaagaagaattaaataaatttaaaaacttttgtcaagaaattgtagatatgaaagatgaagtagagttatttaatgatgttgatgatatacctgataatttcttagatccaattctacaagatattatgttagatccagttcttttacctacatctggtattattattgacagaaagaatattgaaaggcatttaatgagtgaacctaatgatccatttaatagagccccactttcaaaagaacaactagtacccatgccacagctaaaggaagaaattcaaaattacataaataaattaagacaagaaaaaaaaaaaaaaaaaaaaaaaatcgataatatagactttgatgtagaaaatgaagaattcccaaattttcatcaagaacaaaatggagaagtgcaaaaaaatgaaacttcaaatatgtaa

SEQ ID NO: 192 - DNA, 1680 bp, Plasmodium falciparum
tttggtcagcatattcagggggtacaatttatgaatcctaatatgaataacgacatgaacagtaatatgaataatattaataataatcaaatgttcttgaataataaccagaataatgcacatgttcatatggttaacaacatgaatttgaatccctctggaaataattcattttttaataattcaaataaacatctgaatatgatgaccatgagttcaaaaaataaaaaaaacgccatattaaaaaatacagaaaataatgaatttgaaaatataaaaagagtacattcaaacagctccaactataataataataataataataatagtgatagtaataataaaaaatcgattaaaatgaatagcaatgaaaacaataatacaacaacaactattataaaaaatatacgagttgaaaacataaagtttaatgaaagtgtcaatttaaaaaatattgatggcttagatctaagtactaattttgttaatggaaaatatatatccaaattaaataatgatgagaaaatatataatgtagtacattctattgtgaaagattctctcaaagattgtttagttgatttttataataatgcaaattatatttttaaagataaattagattttgtatgtaatagtaatactcctacatgtaataatataaatgatttagaagacaacaaaaaggatgacgggcatgtggataaacaaaattattcacttgaaaagaaagataatgaagaacacacaaataataattctgatcctataatggatggtgttgagttggatgtaaaaaagatatctgaaaagaaggaggatcaaattgaaaaggacaaaccaaaaaatgataatacaaaaaatgataatacaaaggaagacaaaaatcaaaatgatgataataaaactaatacatcaattccaaaaactcccaaaaatgaagttaaaaatgttattacctcttccttattgtcaagttttaatatatttagtgctttcagtaatagtaatacacctaattcgaaaaaaaataaatatgatgaagaggaagaaaaagaagaaaaagaagaagaagaagaaaataataaatgtaatgataaagatgatgaggataaaaataagtctcctcaaaatgaagataataaaaatattaccaatgataataatgataataataataataatgtagacaaagaaaacaatttaaaagaatctatagataacctaggaaatgttgatacagataataatattaagagagatgtactaaattataataatatagaagaaaatgaacaaagcagagaatatattttaatagaaattacaaaaagtatatgctctataatcaatctacaacaattaatgcctgttaatactaggttagctaaccctaatcttatatatgatccaaattatgaaaccatatattctaaatggaaaacatttttaagaaaagagcaatcaagtggaaatttaattagtaattgtttttcacgagattttttacatactattttgttatgtaattatgtaactataattgaagatttaagaaaaacggccgttaagaaaaagttgaaatattttttcttacacttatgtttggaatcgggcatatcgattaacgttgcattgatgctgtttataaatgccacgaagcagagcgataagttacag

SEQ ID NO: 193 - DNA, 2034 bp, Plasmodium falciparum
atggctagtgcaaaaggttcaaaaccaaatttaccagaatccaatatcgctattggaattgatttaggtactacttattcttgtgttggtgtatggagaaatgaaaatgtagatattattgctaatgaccaaggtaatagaacaaccccatcttatgttgctttcaccgataccgaaagattaattggagatgctgctaaaaaccaagtagctaggaatccagaaaatacagtatttgatgctaagagattaattggtagaaaatttacagaatcatcagtacaaagtgatatgaaacattggccattcactgttaaatcaggtgttgatgagaaaccaatgattgaagttacctatcaaggagaaaagaaattattccatccagaagaaatttcttctatggtattacaaaaaatgaaagaaaatgctgaagcatttttaggaaaatctataaagaatgctgtcattaccgttccagcttattttaacgattcacaaagacaagctactaaagatgctggtacaattgcaggattaaatgttatgagaattattaatgaacctactgcagctgctattgcatatggtttacacaaaaaaggaaaaggtgaaaagaacattttaattttcgacttaggaggaggtacatttgatgtatcattattaactattgaagatggtatttttgaagtaaaagctactgctggtgatactcatttaggtggtgaagatttcgataacagattagtaaatttctgtgttgaagatttcaaaagaaaaaacagaggtaaagatttatcaaaaaatagtagagccttaagaagattaagaacacaatgtgaaagagcaaaacgtactttatcatcatctacacaagctacaattgaaatagattccttatttgaaggtattgattacagtgttactgtaagtagagcaagatttgaagaattatgtatcgactatttccgtgatactttaattccagtagaaaaagttttaaaagatgctatgatggataaaaaaagtgtacatgaagttgttttagttggtggttctacaagaattccaaaaatccaaactttaataaaagaattctttaatggtaaagaagcatgcagatcaattaacccagatgaagctgttgcatatggtgcagctgtacaagcagccattttatctggtgaccaatcaaatgctgtccaagatttattattattagatgtttgctccttatcattaggtttagaaactgctggtggtgttatgaccaaattaattgaaagaaacacaaccatacctgctaaaaagagtcaaatctttactacttatgctgataaccaaccaggtgtcttaattcaagtatatgaaggtgaaagagccttaaccaaagataacaatttattaggaaaatttcacttagatggtattccacctgcaccaagaaaggtaccacaaatcgaagttacattcgatatcgatgctaacggtatcttaaacgttacggctgtagaaaaatccactggtaaacaaaaccatattacaattaccaacgacaaaggaagattatctcaagatgaaattgatcgtatggttaatgatgctgaaaaatacaaagcagaagatgaagaaaacagaaaaagaatcgaagcaagaaacagccttgaaaattactgctatggagttaaaagctcattagaagaccaaaaaattaaagaaaaattacaaccagctgaaattgaaacatgtatgaaaactattacaaccatacttgaatggttagaaaaaaaccaacttgctggaaaagatgaatatgaagccaaacaaaaagaagcagaatcggtttgtgctccaattatgtctaaaatctatcaagatgctgctggtgcagccggtggtatgccaggaggtatgcccggtggaatgcccggtggaatgccaggtggtatgaatttcccaggaggtatgcccggagcaggaatgccaggaaatgccccagctggaagtggaccaacagttgaagaagttgattaa

SEQ ID NO: 194 - DNA, 2715 bp, Plasmodium falciparum
tgtgaaatagtacaaaaactatttactaatggcgacctacaaaacacttttaaagatgcgtgtgaacaaaaatatggttacccacaacgacattgggggtggaaatgtataagtgatacaaccactggcaaaagtggtgataacaccggtagtagtggtgctatatgtattcccccgagacgtcgcaaactatatataggtaaaataaaggagtgggcaaacagtggtaacacacaggcggcagaaccacaggaggatggtaaggcacagacaccacaaggtcaaacaccatcacaaagtggtaaagagtcgtcacaaagtcagaaattgcgtgaggcgttcatccaatctgctgcaatagaaacttttttcctatgggatagatataaaaaggttaaaaataaggaaatagctgaaaaaaaacaacgagatagtacaaacccatttggcttcacccagtcaacatcaggtggaatgcaagcattaccagttggaggagcagtacagggagcacaagcacaactacccgatggtgccggtggtagtgaccaaactcccgaaaaacaattggctggtggcaaaatacctgaggttttcttacgtcagatgttttatacgttaggggattatagagatatatgtgtggggaacacacctagtggtatagatacaaatgataaagaaaatatgcaaaaaatacaaaataaaataaaaagtgttattgaaaaaagtgattccacacctcgcacacctggtacccactccccatctagtggtacaacccctcaagccttgtgggataaaatctccccttctatttgggaaggaatgttatgtgctttaacatacaaagatggcggagagggcaaaaaaatagaaaaggttaacgatgcgaacggcgacgaccttttccaaaaactgaaagacaaatacagcgactacaagacagtcacactcgaagaagataatacctcctccgccatgtctaccagtcccagaacctccgaaaccacctcagcctctagtgataacacccccaccctcaacaaccccaaattgagtgatttcgtgttacgccccccctacttccgataccttgaagaatggggtcaaaatttttgtaaaaaacgaacagagatgttggagaagataaaggaggaatgtcgcagtggcacaggaggtcatgaatattgtagtggggatggacatgattgtacggataatgatcgtaaatataataaaatgattgcagattttcattgtccaggttgtgcaaaagaatgtatgaaatataaaacatggataggaaaaaaattcgaagaatttaagaagcaagaaaatacatataaagtggaacatggtaaattaacgaataataattgtagtggtagtgataatacaaaattttgtcaacaaataaaaaataattcttttgataaatttttggaattattgagacattgcaaagatggtaaggatgatacggataaagataatgaattaaattttagtaagcctctccaaaccttttctcgttcaacgtattgtaaagcgtgtcctatatatggagttaagtataataggggaacatatagcgctattaatgaaagtgaatatatgagcaaaaatggtattagtggagaaaataagaacgataagaaacctacggaaattaaagtacttctgttaggtcggaaaggagaagttaggaataatgatgaagaacttaaagaacttaaagaagtttgtaataatgccggttttgttgaggattatagtcttcaaaaatggaactgccaaaaaaagaatggagtggatcagtgtaatcttacaaattctgtggataatatagatgatagtgataaaattattccgtttaatgttttttttcagcgttggttaagaaattttgtacacgattataataaattgaaacagaaaattcatccatgtataaaaaatgaagatggaaaggaacataaatgtattgaaggatgtaaaaaaaaatgtgaatgtgtagaaaaatggttagataaaaaatctacagaatgggatgaaataaaaaaacattatgagaaacattcaaaagatcataatgaaggtattcctcatagtgttaaaggttatcttgtacaggcaccgtttaaggatgaagttctcaaagctataaaaccttgtgattttgataacttcaagacttcgtgtggtcttaatggcactgataattcacaaaatggtaataataacgatcttgttttatgtatgattaaaaaccttgaaaaaaaaattgaacaatgcaaaaagaaacacgacgaaaacaaaaaaacaccgtgtgatccattaccccctctacctgacgaaaacgatgaaacccttgaagaaaacccagtggcgcaaccgaacatttgtccgcaactaccagaggaaccaaaagagacttgtgaagaagcagtcactcctagtgaaccaaaaaaagcggaagaagaaccagcagcagaacccgaagccgtgcccgaagaagaagcaccgttacctccacctccccctgcggccccacctcgtgagagcaaagaaaaagcaaaaccccccccaaaacctcgaatcaaaacccgtcatgtattggaccaccccgctgtcatacccgccctcatgtcttctaccatcatgtggagtattggcatcggttttgctgcgttcacttatttttttctaaag

SEQ ID NO: 195 - DNA, 1416 bp, Plasmodium falciparum
aaaaaaaccaaatcatctgttggaaatttatttcaaatactgcaaatacccaaaagtaattatgatataccgacaaaacgttcacccaatagatatataccttatactagtggtaaatacagaggcaaacggtacatttaccttgaaggagatagtggaacagatagtggttacaccgatcattatagtgatattacttcatcttccgaaagtgaatatgaagagatggatatcaatgatatatatgcaccacgtgctcctaaatataaaacgttgatagaagtggtacttgaacctagtggtaacaacacaacagctagtggtaaaaacacacctagtgatacacaaaatgatataccaactagtgatacaccaccacccattactgatgatgagtggaatacattgaaacatgattttatatctcaatatttaccaaatacacaaaatacggaaccaaatattttacatgataatttggataataatacccatcccaccccgtcacgtcatacgttggaccaaaaaccttttattatgtctattcatgatagggatttatatagtggagaagaaattagttataatattcatatgagtactaatagtatggatgatccaaaatatgtatcaaataatgtatattctggtatcgatttaattaatgacacattaagtggtaacaaacatattgatatatatgatgaagttttgaaaagaaaagaaaacgaattatttggaacaaattataagaaaaatacatcaaacaatagtgttacgaaaaatattaatagtgatcctatagataatcagttgaatttgtttcatacatggttagatagacatagagatatgtgtgaacaatggaataataaagaggaactattagataaattgaaagaagagtgggaaaatgagacacatagtggtaacaaacatagtgacatacctagtggtaaactaagtgatacacctagtgataacaacatacatagtgatattcatcctagtgatatacctagtggtaaacaaagtgatatacctagtgataacaacatacatagtgacataccatacgtgttaaatactgatgtttccatacaaatacatatggataatcccaaaactacaaatgagtttacatatgtggatagtaaccccaaccaagtggatgacacctacgtggatagtaaccctgacaattcttccatggatactatcttggacgatctggaaaaatataatgaaccttattatgatgtacaagatgatatttattatgatgtaaatgatcatgatacatcaactgtggatagtaatgctatggatatacctagcaaagtacaaattgaaatggatgtaaataccaaattggtgaaagagaaatatcctataggagatgtgtgggatatataa

SEQ ID NO: 196 - DNA, 1722 bp, Plasmodium falciparum
atgaaacgcattagccctctaaacacccttttttatttaagtttatttttttcatacacatttaaagggttaaaatgcaccagaatatataaaatcggaacgaaagcgttaccgtgttctgagtgtcacgatgtatttgattgtaccgggtgtttattcgaggaaaaagaatcttctcatgtgatacctttaaaattaaacaagaagaatccaaacgatcataaaaaattacaaaaacatcatgagtctctaaaattaggggacgtaaaatattatgtaaacagaggagaaggaatttccggaagtttaggaacgtcgtctggtaatacattagatgatatggatttaataaatgaagaaataaataaaaaacgaacaaatgcacaattagatgaaaaaaactttttagattttactacgtataataaaaataaagcacaagatatatctgaccatttatctgatattcagaaacatgtgtatgaacaagatgctcaaaagggaaataaaaattttacaaataatgaaaacaattcagataatgaaaacaattcagataatgaaaacaattcagataatgaaaacaatttagataatgaaaacaatttagataatgaaaacaattcagataatagttcgattgaaaaaaattttattgctttagaaaataaaaacgctacagtagagcaaacaaaagaaaatatttttctagtacccttaaaacacttaagagatagccaatttgtaggagaattattagttggtaccccccctcaaactgtatatccaatatttgatacaggaagtacaaatgtatgggtagtgacaacagcttgtgaagaagagtcttgtaaaaaagtccgaagatatgatcctaataaatcaaaaacatttaggagatcattcatagaaaaaaatttacacatagtatttggatccggttctatatcaggttctgtaggtacagatacatttatgttaggaaagcacctagtaagaaatcagacttttggattagtagagagtgaatcaaataataataaaaatggtggggataatatatttgattatatatcctttgaaggtatagtaggcttaggatttccaggaatgttatcagctgggaatataccattttttgataatttattaaaacaaaatccaaatgtagatcctcaattttctttttatatatctccttatgatgggaagtcaactttaataattggtgggattagtaaatcgttttatgagggcgatatatacatgttgccagtattaaaagaatcctactgggaagtaaaattagatgaattatatattggtaaagaaagaatatgttgtgatgaagaaagttacgttatatttgacacaggtacatcttataatacaatgcctagtagtcagatgaaaacatttttgaatctaatacattcaactgcatgtactgaacaaaactataaagatatattaaaatcatatcctataattaaatatgtttttggtgagctaatcattgaattacatccagaagaatatatgattttaaacgatgatgtatgtatgcctgcctacatgcaaatcgatgtaccatccgaaagaaaccatgcatatttattaggcagtttatcttttatgaggaatttttttacggtatttgtacgaggcacagaaagtagaccttctatggttggagtagcaagagcaaaaagtaaaaactaa

SEQ ID NO: 197 - DNA, 2028 bp, Plasmodium falciparum
atgtcaaattggaatttttttaatgattacctaaattggtttaatgggaccaccgaatctacaacatttcataatagaagtagtaaaaagggttctaacaaaagtgtatcaacaaattctacttctataaacactaataaaaataatattaatgagcttagtaacagtcaacctaataatagtggacaaacttgtgatgaaatgaaggcctctaatgatggctttgaaaaagatgtaagtaaaataaagtgtgccaagaaatacaatccatttattaatataaaagaaaaatattataaagaatataataatatgaatactaaaaaggagaataataaaagtgaaaaaaaatgtggaattcaaattgaaggtcaaaatggaaatccaagtgaaaatccaagtgaaaatccaagtgaaagtcaaaatgaaaatccaattccatgtcaaattaaaaaatgtgataaagagaatgatcagaatatacccaaaagtggtaataaaaataaagatacaaatttttttaaccaactagggttatcaaactggttacctaattatgatatgccaatttataacgaatataaaaaaggttattatttagataaagaagcaaaagaggttttatccaaaaagggttctaaaaaaagtaatgttataaaaataggaggtgatagtagtaatagtaatatgaacgattttaacgtatccgattgtggtaataatacatgtgttgatacaacatattacgatgcattaaatataaaaccgacagcaaaattaagtgaaataaaaacaagttattataagttagcattaaaatatcacccagataaaaatgcgaatgatccagaagcaaaattaaaatttcaaaaaataaatgaagcttatcaagttttgagtgatgatgaaagaagaagacaatataataaatatggattaaatgcaacaaaggacatgatattaattgatccatccatattctttatgatgttatttagttcggaagaattaagtgattatactggtaccttgagaatagctttttttgttcagctagcttttgaaggtaatatgtccatcgaagataaaaaatcatctaatcaggttatgataaatgagatggaagtagaacaaaaaataagagaagtggaattggctttactattaagaaaaagattacaaccatatgtagatggagatgtggaatgggaggaacaaatggaaaccgaaataaaaggattacttgaatcttcattttcgagttctatattagaatctataggatggacatatgaaaatgtcgcaacatcttatatagctgaagtaactaccttatggggtgtcggagcaacggtagctaatattcaggctgctggaaggaccattggaaataccttcagtgcagctaagtctatgtttaatactgtagtgactataaaagatttttcgttgaatagtgaaaaaattaattctataaaagaaaagaaagataatttaaaaacatcatcgaataattctctgaataatcattcttcttccaataaaggatccagtgaacaaaatggaacaaatgaaaatttaaagtgtgataataatcaagtgaaccataagaataatgtaaacacttcagacaatataaataatgtgaatacatctaatacacacgaaaataaggaagaagaaaaaaaaaacacaattattgataaagaagaaaataaagctctaggagttattataaaaaatgttctcaccttagttttatgggatatcgaatcgacagtaagacaagccaccgagaaagttataagagatgaagatgtgaacattgaaacacgattaaaacgtgctgaaggaatgaaatttttaggaaaattaatgcaaaaatggtcaaaaatcaaaaacgataaatgtgatacaaacgatatcgatgctaccaaacttttagaaaaagctattatcaaagcttctaaaatgccaaacgacgaagatcaaggagaccaagataacatcaaaagagaatacctatag

SEQ ID NO: 198 - DNA, 1761 bp, Plasmodium falciparum
aatgttgaaatattaaagaatgattataatacgctaacagaaagtcataatataattaatagaaggtctagaaatttaggagcgaatccagaatccattagtttaggttatgaattaagtgaaaaggatgaaggaaataaaaatgatctaataaatagtgctacagatgtatcaacagaattagagaatttaaaagaacgtttatttcctgaactagaattatatacaaacgatcaaaattcaagaaataatactccaaatttacgtaagggttctttgggatttgatagttttaaaaaattggaattaggaacactaaatcaatttgataaagataaaatgattaatctgaaagatgaaaccaatatgaatgaatttgaaggatttctaggaagaaattcaatggctagtaatgtagttacatccgaattatttgatgaaccagtagatgatagtagtagtactactactagcacaggtacaaaattgcaaaacgttccatcgaatgataataacggtgaacttttgaaagatgaacctatagatgattatataaataataattcgaaagttgaatcggaagataattattatgcacaacagaatatgcaaagtcagtcgaaagataattatgcttcagaacaaaatgtagcagatcaatcgacagataattatcctacgcaacatgatgtaccagttcaattgagagacaattatgcttcagaacaagagtattttgatagaggtgaacaattgaatgacgtaagtgcagataacaatacaagtaataaattgaaagacgaacctgtagataacaatacaagtaataaattgaaagacgaacctgtagataacaatacaagtaataaattgaaagacgaacctgtagatgacaatacaagtaataaattgaaagacgaacctgtagataacaatacaattaataaattgaaagacgaacctgtagatgacaatacaagtaatattttgaaagacgaacctgtagatgaccatgcaggtaaacatttgaaagatgaacctgtagatgaccatgcaggtaaacatatgaaagatgaacccgttgatattgatagaacaaatattaaaaagggtttaaatgaacaacatgttaatccatggactacaacattagcagatttaaaaaatattaataatagtatgaaaatagaaaaaaataataaaagtaatgaacaggtaaaaaatacgagcgttagcaaatcatgtgatattataaaaccttccaagtttaataaaaagaacctttttgagcaaagacttcaaagtgttgaaggtaaaaacttttttgaaggaagaagtcaaaatttagaaggaagaagtaattttgatgagagatctcaaattgtagaacaaaggagaaactttgatgacagggaccagaacataatggatagaaaaaattttgatgaaagaaatcaacaggttaatgacagaagaaattttgatgaaagaaatcaacaggttaatgacagaagaaattttgatgacagggatcagaacgtaatggatagaagaaactttgatgaaagaaatcaacaggttaatgacagaagaaattttgatgaaagaaatcaacaggttaatgacagaagaaattttgatgacagggatcagaacgtaatggatagaagaaactttgatgaaagaaatcaacaggttaatgacagaagaaactttgatgaaagaaatcaacaggttaatgacagaagaaactttgatgac

SEQ ID NO: 199 - DNA, 1755 bp, Plasmodium falciparum
agaaactttgatgaaagaaatcaacaggttaatgacagaagaaactttgatgacagggatcagaacgtaatggatagaagaaactttgatgaaagaaatcaacaggttaatgacagaagaaattttgatgaaagaaatcaacaggttaatgacagaagaaattttgatgaaagaaatcaacatgttaatgacagaagaaattttgatgaaagaaatcaaaatgttaatgatagaagaaattttgatgaaagaaatcaaaatgttaatgatagaagaaattttgatgaaagaaatcaacaagttaatgacagaagaaattttgatgaaagatatcaaaatgttaatgagagaagaaattttgatgagagaaatcaacaagttaatgacagaagaaattttgatgagagaaatcaacatgttaatgagagatatcaaaatgttaatgatagaagaaattttgatgaaagaaatcaacaagttaatgacagaagaaattttgatgagagaaatcaacatgttaatgagagaagaaattttgatgagagaaatcaacatgttaatgagagatatcaaaatgttaatgatagaagaaattttgatgaaagaaatcaacatgttaatgagagacgaaactttgatcaaagggctccaaatgtagaagagcgaagatatatggatccaagaaatccgaatattccatatgtaaggtttccacatcatcagtggggtcaaggaatgatgtatggaagaccatattatccttgggttccatttatgggagatggaagaggttataatttttataatcctcatcaacatatggtatatggaagaccctattattgggtacctccacccccagcgttagaatatacaaaaggatttaatccaatggaacagagaagagaagaagacaggggacatatgggaggaagaggtagtagatacccagaagaggaaagatataattataacaataagagaagtaatagtatacctgaaggacgaaattatgaagagaatgcatatgagagaggaggagggaataataaatgggattttcgaaatatgtatgatagattaagagatgaagatgaaaatgattatgaccaacctcctagtacatcttcttctaatagaggaagaggtaatgaaagatatagtcaatcaagagatagaagagaagaaaggaataattataatagtgattattatactagaggaaatgagagaacatataataattcaaatgtaacaagtagttcaaatagagaattaataccttacaaaaaagagatattaccttttggtgttagtaattctgaattggaagataaattaacagaagaggaattaaatgaaagaataagaagattagattatacagtatctgttaaagatatgtttatattatggaatcatatacttgcacatgaaagaaaaaaatatacaaaaatgcaagaatatttaatgtattatagtcaatatttagaaaaaacatatcttgttcctacagcttttagaaaaaaatactggtggagggttcattatatgttgaccgaagaagtagttaaaagagaaaggacagataatttagatttccatcaattcttacgtaaaggttcttgtgaaaaacgtgaatttttatattttattaattctaaaagaaaaggatgggctgatcttacggaaacaatgaaaaatatatggatggaaagattaacttataaaatgagaaaatatagtggagcataa

SEQ ID NO: 200 - DNA, 1308 bp, Plasmodium falciparum
aaaaaaaccaaatctactattgatcttttgcgtgtcattaatatccccaaaagtgattataatataccgacaaaactttcacccaatagatatataccttatactagtggtaaatacagaggcaaacggtacatttatatagaaggagatagtggaactgatagtggttacaccgatcattatagtgatattacttcttcctccgaaagtgagtatgaagaattggatattaatgatatatatgtaccaggtactcctaaatataaaacattgatagaagtggtactagaacctagtggtaacaacacaacagctagtggtaaaaacacacctagtgatacacaaaatgatatacaaaatgatggtatacctagtagtaaaattacagataatgagtggaatacattgaaagatgaatttatatcacaatatctacaaagtgaacaaccaaaggatgtaccaaatgattataaaagtggtgatattccattcaatacacaaccgaatactttatattttgataaacctgaagaaaaaccttttattacttctattcatgatagaaatttatatagtggagaagaacatagttataatgttaatatggttaatagtatggatgatattccaattaatagtcataataatgtatacagtggtatagatttaattaatgacacattaagtggtaatcaacatattgacatatatgatgaattattaaaaagaaaagaaaacgaattatttgggacaaatcatgtgaaacaaacaagtatacatagtgttgccaaacctataagtgacgaccccatccacaaccaactggaactattccataaatggctagatagacatagagatatgtgcgaaaagtgggaaaatcatcacgaacgattagccaaattgaaagaagagtgggaaaatgatacatcaactagtggtaacactcaccctagtgatagtaacaaaacgttaaatactgatgtttctatacagatagatatggataatcccaaaactacaaatgagtttacatatgtggatagtaaccccaaccaagtggatgacacctacgtggatagtaaccctgacaattcttccatggatactatcttggaagatctggaaaaatataaagaaccttattatgatgtgcaagatgatatttattatgatgtacatgatcatgatacatcaactgtggatactaatgctatggatgtacccagtaaagtacaaattgaaatggatataaatactaaattagtgaaagagaaatatcctataggagatgtgtgggatatataa

SEQ ID NO: 201 - DNA, 2505 bp, Plasmodium falciparum
gacgtatgtggtataacggaccaacataccaaggatagtcgtcgtcgtcgtcgtcttcgtcgtcttcgacttcttgttcttcgttttcgtcgtcgtcttcgtcgtggtcatcgagattataaaggaccatgtacaggtaaagatggacacaaaaagatgtttcaggtagaaaaaggatgggaaaatgggagcaaaataggtacagaaaatgacgttttcttgccaccaagacgtgaacatttttgtacttccaatgtggaacatttgtacagaagtgccagcggacttcaaggaactactgccagccactctctattgggggatgtgttacttgctgcgaataaagaagcaggattcataaaagaaagatataagacgcaaaaaacttcagaaggttttaaggacgaggcaactgtgtgtagagcaataaaatatagttttgctgatattgcagatataattaaaggaacagacttatggaaagcaaattccggaaaaaaaaatacacaagataaattggtaaaaatatttcaaaagattaaagacaatcttcctgttaacatcaaaggaaaatataacgaagatgaaaaacatttagaattacgtaaggattggtggtttgctaaccgtgacaaagtctgggaagcaatgaaatgcgaacaaaacggtatcacttgtagtggtcctaccccattggatgattacatccctcaaagattacgttggatgaccgaatgggcagaatggtattgtaaagcacagaaagaggcgtatgacaagttgaaggtgtgtgagaaatgtatggataatggaaaatgtacgcaaggtaatggcgagtgtgcaaagtgcaagacagcatgtgaaaattataaaaaatttattaatacatggcaacctcaatggaaacaaatggaacaaaaatacgaaagtttatacaaagaagcacaagaaaatggtaatagtagtcataaaagtactacagaacaagacaaatatatggtagaattcctgtcacaattacaaaaagcaaataatggcgacaaaactggtgacgataaagtgtattctactgctgcaggatatgtacaccaagaagctacaatgaattgtgagaaacaaactcagttttgtaaaaacaaaaatggtgtcaaggcagctaatgatgcagaagacgtcaattatacctttaaggatacgcctaatgggtatgatgtggtatgtaaatgtaaagataggccggagcaacagataaaaaaaaaggaagtagaagatgcgtgcaaaatagcgcaggacatatttaagggtaaggatgaaaacactacagtagggctatgcaaaaaaaaagattttggaagaactccttatcccgattggaaatgtgaaaaaaattcaaaattggtgacaggaaatggtgaatgtatgcctccaagaagacaaaagttatgtttatactttttggcacataaaattgaaacaccaaatttaaatacacaagaagatttgagaaaggcttttattaaatgcgctgctgcagaaacattcttctcatggtactactttaagaaaataaatgataaattaaataaactcgatgaaaaattaaaagaaggagaaatccctcctcaatttttaagatccatgttctacacatttggagattataaagatatatgtttggatactgacatatctttaaaaactgaaaatggtgatataactaaggcaaaaagcaatatagacagaattatcccaaaaaaaagtgccaaaaatcctgatgaagaacgtaaaatttggtgggatggaattaaagaagatgtatgggaagggatgttatgtggattatcacatgctgtcagtaataatgacaaagcgacagtacaaaaaacacttactaccaagaccatctacgactatgacactgtgacatttgatggtaccaccaaattggaggatttctccaagcgaccccaatttttgagatggatgacggaatggggggaagagttttgtaaaaaacggaaggaacaattagaaaatttaaaagacaaatgtccagattatacgtgtagcttcgatactaaaaaacaagaatgtgaaaatcactgtaaagtatatgaagaatggctaaaaggttggaaagaccaatataaaaaacaaagcgaaaaatttacaacagataaagaaaaacctgaatataaagatgatcccgacgttgccagctccgaaaatgctcacaaatatttgagcaaaaaattaaaacaaatttttcacaatggaagtactactgagaaatgtgattatacgtgtatggaatatgcgtcaagacaaccacaaacatctgcttgcagtcaacaacaacaacaacaaaacaaatcatctacacaaaaccatttccctgaagcgttcgattatcctcctaaagaaattggtgataggtgcacttgtcctaaacttccggaacctaaatattgtgtagacaaaaccgcatatgatataagaaaagag

SEQ ID NO: 202 - DNA, 2496 bp, Plasmodium falciparum
cttccggaacctaaatattgtgtagacaaaaccgcatatgatataagaaaagagagtgggaaaaagtcggataatagtttgaaaggaaatggtaatacatacaataataattgtaataattccatgagggaagagtatgccaatcaaaatggagaaacatgtaaatttaacgaaacattttggtccaaaaaaaaaccttctattgaagaatgtgatatcaatgcaaaagagcgttttcaaatacagaaatattgggattgtaatgggaaaacacctgatggaaaaaacacattttgtatccctccaagaagaaaagatatgtgcttgaaacaattggaagaaataaattctgcagatgttaataatagcaaaaaattacttcaaaaaatccaagatgtagcaaaaaaggaaggagatgatataataaagaaactattaccaaaatatccttgtaatgaagatgtaatttgtaaagctatgaagtatagttttgccgatttagcagatattgttagaggtatagataaatataaaggtccaaatggtaccaatgtacttgaaaaagaattaaaaagtgtttttgagacaatatatacaaaatggaaatccgaaaacacaaataataaaagtaaatacaccgatgtagcctcttttcgttccgcctggtgggatgctaatagaaaagatatttggaatgctatgacgtgtaatgctccttatgatgcaaaaatttatattaccaaagaaggaggatatatatctcctttaacgttcacaaaaaacaaatgtgggcataatgatgatccacctgattatgattatatccctcaaccttttcgatggctaagtgagtggagcgaaacctactgtcttgctcaaaaagatttattggaaacgatgaaaaattgtgagaattgcatgaaaaaaaacaaaaatgcagattgtgaacagacacaatatggagcttgtagggactgtaaaagaaaatgtgaagaatacaagaaatttatagaaatttggaaaaaacagtttgaaacacaaaacaaagcatatcaagaaatatatagaaatgctacaacaactaacagagataataataatattgttgatgaaaatacaaaaaattttgtaaaaaaactacaggaaaattgcagaaccgaccgaaacgaatctcttgatactgccgataaatatcttgaaaatgcaagtgtttgtcgaagatttaaatttgggaataaggactcacgtcatctaaattatgctttccatacagatccacctagttatgaagagcattgcaaatgtgcgaaagattttgatccattggatgaatgtcctgttgataataacgaatgtaagaagtatggtataggtagttgtccaaaaaaaaatttccataaaaaattggaagaatggacaaattacgttttaaacaacaaatcaaataaaaataaatccgcaatagtacctcccagaaggagacaattatgtctacaaaatcttacgagaaatttgagtcgtctaaataaagaaaaatcatttaaagaaggaattcttatttcagctgcttcggaagctaaaatgttaactgaacaatatcgtgagaatcctgcaaaggcacttcaagcaataaaatacagttttgctgatattggaaatattataaagggagatgatattatagggaatgttatatctgtccaactaaataagttaattaacggaaataaaaaaataaatacatctaccttatggtgggaagcaaataaagaaaaaatttggaatgccatgatgtgttattacactggagacgaaaaaacagctactagttgtccatcacatggaaatattgataaagaagatcaatttttactatggtttcaggaatggggagaaaatttctgtgctagacaaaaagaattatatgaacacgtacaagcggaatgtagtcatgttatatgtgtcaatggtactggaaatattgacagtaaatgcactgaagcatgtaaaaattatagtaattttatttcagaaacaaaaaacgtatatcagtcattaaagaagcaatataatgataatcataactctatcaaagtaggtggtaaagaagttcatcattatatgaaagaaaaatgtaaagataaatgtgaatgtttgtctgaaaaatttaacagtgacaacaattgggaaaaaccgtatgacacatttgacgataccgtactcaaaaacaaatgtcagtgtaaaaaacctgattccccaattcttccagtagaaccttcagtgccagctgaaacggaaaaagaaaaaaaaaaagattcacctcttaaaccccatactgaaccaaaacctgcaccccccaaaaaacctgaggtacccccgcctccacccgtacaacccccccctgcgaaccaacccttcaatcgtgacattctggaaaagaccattccttttggtattgcgttggcgttaggttcgatagcgttccttttcataaag

SEQ ID NO: 203 - DNA, 1179 bp, Plasmodium falciparum
aaaaaaccgaaatcacctgttgacctcatacgtgtacttgacatccacaaaggagattatggaatgcctacactgaaatcaaaaaatcgatatataccctatgctagtgatacatataaaggcaaaacatacatttatatggaaggagatagtgatagtggacactactacgaagatacaactgatattacttcatccgaaagtgaatatgaagaaatggatattaatgatatatatgtacctgatagtcctaaatataaaacattgatcgaagtagtattggaaccatcaaaaagagatacacctagtagtgatgcacctatgaataaatttactgatgacgaatggaatcaactgaaacaggattttatttccggaattttagaaaatgaacaaaaggatttacctaaaaataatataagtgggaatactccaatgaatacacaacccaatactttatattttaataaacctgaagaaaaaccttttattacttctattcatgatagggatttatatagtggagaagaaattaattataatataaatatgagtactaatagtatggatgatacatcatatgtatcaaataatgtatattctggtatcgatttaattaatgacacattaagtggtaaccaacatattgatatatatgatgaagtgctaaaaagaaaagaaaatgaattatttggaacaaattataagaaaaatacatcaaacaataatgtagctaaattaacaaatagtgatccaattatgaaccaattagatttgttacataaatggttagatagacatagagatatgtgtgaaaaatggaaaagcaaggaggatatattacataaattaaatgaacaatggaataaagataatgatggaggtaatgtaccaatagataacagatcgttgaatacggatgtttggattgaaatagatatggatgatcctaaaggaaagaaagaatttagtaatatggatactatcttggatgatatagaagatgatatatattatgatgtaaatgatgatgaaaacccatctgtggataatatacctatggatcataataaagtagatgtacctaagaaagtacatgttgaaatgaaaatccttaataatacatccaatggatccttggaaccagaatttcctatatcggatgtatggaatatataa

SEQ ID NO: 204 - DNA, 624 bp, Plasmodium falciparum
aaatatattcaaaattttgttaatatacaagaaaccttaaatgaaaaatgtagttcaaaatatataagattgatatcggaacaaacttctgatgaatctacaagtaaatctataaaaaattgtaaatgtgtaaataaacggaacaataaaaatgaggacaatcatgaattacaatcaaaatcaagatctttaaaaggaactgaattagatgttacttcatataataaatcaaaacatacgcaacaaaacaatttaggagattcattgaagagaacaaaaaataatattacaaatatatcttctaaaaagaatgaaacatatttattcgatgaaaatacaaatgaatacaaattaagaaatactttacgtcttatgaacgaaagatatgctgatagtatagtagatactatggatcttaatgataagacaaaagataaatttaaaaaattcttacatttatatatggcgaaggaaaatccagataaacaacgtaagttatatgaacaaattgaaagtgatatagaaaaatacaaaaaaaatcatgttatatgtagcatcgttgattttgaaaatatatatgattctttttattttttaaaatacgaagatagatatataacttga

SEQ ID NO: 205 - DNA, 1878 bp, Plasmodium falciparum
aaaaattatcatcgtccagaatgtggaatgatagatttatttggtagagttatgtgtggtactattaaaaaaggacaaagcgttcgtatattaggagaaggatatacattaaatgatgatgaggacatgataacaagagtaataacacatttatggatatatgaaggtagatatagaatagaagtcgatgaaatacctgctgggaatttttgtttaattggtggtatagatatatgtataaataaaacatgtacaattacaaatgtgaaaataaaaacaaataaaaataaggaagatcatgttaatttaaattggtatgacgatctaaatgatgatgataataatatagtaaaatataaaaatgataaggatatatataatttagacaaatcggctcttttgaatgataatgaaaatgcagaaatattttatccactacataaaaaatttcgttatttaaattgtgtgaattctgtttttaaagtagcatgtgagcctattaatccatctgaattaccaaaaatgttagaaggtcttagaaaaattgataaggtgtatccattatctagtacaaaagtagaagaatcaggagaacatataatattaggaaccggtgaattatatttagattgtattttgcatgatttaagaaaattatatggtgatttagaaattaaagtgtctgatccagttgttcaatttaatgaaaccattattgaaacatcagcacttaattgttttgccgaaacgccaaataagaaaaataaaatatatatgatagcagaacctgtacaaaaagagttaggtgatgatatagtccaaggactagtacatctaaatgaagaccaaaatttaaatgtaaatgagtatataagtacaatggataggatattgaataaaaataatgaatctaagaggaatatttatgatgaaaaggatgattcacatgatgataatgatgatggtgacaatatggagaatcatatgaatggtattgagaacaaaaaaaatatttttaaagataaggaacaaaaagatgaacaccaaataaacgatttagataaggaaaaaaggaaaagcaccttaaattacaatatagatcctaatgtaatatcattattaaaaaataaatataattgggacattttatctattagatctctttgggcttttggtccagaaaataatagtccaaatatattggttgatgattctttatttcaagaaactaataaagaaaatttatactctataaaagataatattattcaaggattttcatgggcaactaaagaagggccattaattgaagagagtatgaaaggagttaaagttaaaatattaagagcagatattgatgatgatccaattaatagaggagctggacaaattatacctactgcaagaagagcaatatattcttcagttttattagctactcctagattattggaacctatattattaaccgagattatatgttcaggagattcagtgtcagctgtatataatgtcttatcaagaagacgaggtcatgttttaaaggatttcccaaaggtaggtacccccttatatatggtacatgcttatataccagcaattgaatctttcggatttgaaacagatttaagaacacatacaagtggtcaagccttttgtattagtatgtttgatcattggcatatagtaccaggagatccattagataaatcggtaatcctacgacctctcgaacctgcacctatacaacatttggcaagagaatttttattaaaaactagaagaagaaaaggattatcagaagatgtgacaattaatagattttttgatgaccctatgttattaaatataaaggatgaattttcagaatatttttag

SEQ ID NO: 206 - DNA, 2421 bp, Plasmodium falciparum
attggaaaaaatttccagatgagaagatttcctattaaaaagttaggttttgaaaaagctaaggaactagctattcaatgtagattagaagcagaacaagctggtgcgacaactacagaaaatcgaaccaaacgtatgagaaatttattaacacttaattctgaaaatgcattagaaatgatgatagatcaaaattcaatagataatgatgatagtaatatacatcaacatatgaaagagaaggggggtggaatgaatggaaatttacgtatgtcacgcatgcaaaattatgctggtgcaggtataagtggtcaaagtgtacatcaaacaaataaattacttaatagtgatgcaggtcaagatagcgaaaatgagttttcacctacgaaaaggacaagagcaccacgaggaagaagaatggagagtttgacagctcgagctagtgcattaacaccagttgaaggggttcgttttgatccttattcttattcttggtttgctaaatatttagaaaatgaaaattcgaaagaacccaaaatttctaagtatttattgaaaaaatggggtttcaataaggctcatagtttggcagttcatactgtaaaatgtgcatataaggcagttccatttacagatgaggaattggtaaatatatttaatgtggatgttaataatttaataaataatcagaacaatatgattaacttgggattccacgatggatttggaactaatggactcatgaagactcagttgaataatcagatgacaaaccagatgacaaaccagatgacaaaccagatgacaaaccagatgacaaaccagatgacaaaccagatgacaaaccagatgacaaatcagatgacaaatcaaatgacaaaccaggtgaataatcagatgacaaatcaaatgacaaaccagatgaataatcagatgaaaaatcaggtgaatagccatataaatagccaagtagctggtcatatgaacgcaaatatgtttaatggaaataatagcaatggtactaatatgcttgggaatatgaatatgctaaataatatggtgaatagcaatatggataataatgtgaataataattatagtaataattatccaggaagtggaaataatggattgaataatatgacaagttgtgttatgaataataatggtggtgagatagatatggatgataatgataatatagagaataacgatcatgaaaatatgatgacacttgagaaggaagatagtataaataatgatagtataataacaacaacaacagcaactaatataaatagttgtaataataatagtaataatgcaaattcgttattaaataggttggtgatgtctaacggatcgaatggtaatacaaaattgaatatcataaataattacaataataataataataataatagtagtagtggtggtggtgttatggttaatataaataatgtgcataataatgataatatgaatacctataacaacaataataataatattttaaatgatggtaatagtgttgtaggaaataacgagagtatgattcataagaaaaatgtggtaaattgtataaataatgatgtagaggacgatttaggaaacatgaataataaccataacaataataataataataataataacaacaataataataataataataacagtaacaataataacaataataataacaatttgaacgtttttatgaatgagcataataatccaaccaacaatcgtggtatatatgggagcaatgaatctataaataataatggacttatggatgaaggtcgacttaattttattcatacggctgggaaacacgttgataagaataatatgcagagcggttcaacaactgtagttaatgtattaaataatgatgagaattatataaagagtaatataaattatacaaatatggataatatgaaaaataatgacaatcccatagatgatgataatcctaataatattgtagaaatgaatcttagagttgagaaaaatattttaaataataataatgatgaacatataataaataacacagaagatatgatgtctacaaataataaagagaattgtacattaaacggtcaaagtactatacttatgaatagtaatgaagaaaatgatgaaacagcattagatactattattcaaccccctatagaaaaaaggaattatgttaatatgatgataaatgaacaaggaacagctgataacaattcaaatgtagacagcagtaataatagttattcaaataatgtatatactaaaaatttaaatagtaattataatggttttaataatgaaaattcaaacactactactaatgaacaaaatgattcctctctttattttatgaatgtaaattcagaaattcaaacagaacatttataa

SEQ ID NO: 207 - DNA, 2934 bp, Plasmodium falciparum
atgatggaaagaggaagatcaaattatagacgtaataatgaaaataataattttagagaaggaaatataaaaaatgaaacaggagatgataatcatttttggaccaatatcgataattattatttttgtaattttgataagagtataatatcagcatttgaaaatcatataaaatgtacagattatatttgtaataaaataaaaaagcggaagataaataaaaaattatttaaaaatattaattgttataaaagttcagtaaaaataaaattaaatggaaatgataaaaatgaacataataataagaagcttgtttgtgcaggtacaaatatgcaatatgacaattatatgaaattcaatgaaaataatatgaataatgtgaataatgtgagtaatatgaataataagaataatatgaataatatgaataatatgaacaatatgaacaatatgaacaatatgaacaatatgaataatatgattaatatgaataatatgaataatatgattaatatgaataatgtaaaccatatgaataatataaatcatatgaataatttaaatcgtatgaataatataaatcatatgaataatataaatcatatgaataatataaaccatatgaataatataaatcatatgaataatataaatcatatgaataatataaagacgagtgagaattataacatttcaaataataataacaaatgtattcaaaataataatattaatgataaaatattaaataatcaaattcagaatgttatgacttttgatgataaaaaatctattcttgaatttatgcctatggcgaaaaatgaattattattaaatacattacatcacttaaatttaagaaatgaacatcctacaaatccttttccgaatatgtatagaaatcctaattattttaataaagacgaaaattatatgtttcttaaaaatcaaggtcctataaataatttaaataataatgttcttcctaataataacaacctgaataatttgaatacccatgtgaataatcaaatggtagaaaacaataataaaacgatgcctatcccattgaataatctaaatgcatacacaaccaataacaacgataacaataataagaataatattttattaaataataatgaacataataacaatccagtaggtggcacgaataaattatcggataaaaatttggaattcttacaaatagaagaattacataacaaagaaggaaataaaaatacaaacgatcaacaagttattctgaaggaagaagaaagagatattcaagttaattcaaataatgaaaagactacgaatgaagaaaacatattattaaatgatttacaaaaaaatacaaataataatgaaacatcaaatgatacaacaccttttaaagatgttaatgatgatattaatattcttaaggaagaaaatgaaaaggaaaatgttataagtaataaaataaattccattaatttggctcattccaccatacaaaatgataatgaaagaataaataatgaggacaataaaaataaagaaaatgtaactattcaagataattatagtaataataataataataataatatcaatagagggtgtgtattgaacaaaaaccaaaataatataaatagtatgaataacataaataataataataataataataataataataatatgaacaattttaataattttcatctaaaccagaatgtacccaataatgatatgtttaaacaacctcttttatttaacaagccaaatatgatgaacatgcatgcttatcatatgaataatatgaaccctagtgaacctccgttttttaacggtccaataattaataacaataaacaatcagtgcaaggatatataaatcctatgaatcataatatggtaaatatgtataattcattcaatcctaatatgagaaatgatattatgaataaacatatgatgataacaccaaacaatctaaatataaatgatgataaaaatatgacaacggatatagataaaactggatatacgtgtccatctaatatgttaccttatgataatatgttaataaataatcaatttagggttaaagatccacatgcatttatgagaaaaagtcacgaaacgcgcattaggaaatttaatgaaaatgatataaaagatgataataatgatgataataataataataataataataatgttaacttggataaatataaaagaagcacaagaagctcaaaatatgatgataatttcttcaacccttttttaaataagaaatatgatggcctagggaaattgccatatatacaaaataaaccaataccaaacggcttacatatatctatctatattccccagtcgtatgattttacggatgaggttaaagatcaagatataaaaacatatgaagacacaaataaaaataatgataaggtaaatacaatatgtgacgaaattaaaaatacagaacatacagatcacgaaaaagatagaaaaagtgtatcatttgaacaagaaaaatcggaattaatcagcaatgaagaatatatatatgaaagagaaacattagctagattattaacagaaataacctttggtgataagaaaaatttgtttaatcctaagatgactagtgaaaataaagaaaaatgttataataccatattaaatgaactaaaaacttataaatcattaccaatcattttgggtaatattttaccttattggacaaaggataaaaatattaagaaaattaaaaaaagcatagaaaagatgaataaaagaaaaaaaaaagtagacaatccacagaaatatccaaatttattttataaaattaaaaatttgaaaagaaataatgataagctgaaatatatacatataagtaatattaataaaaaaataaaaagagcaatgatgaat

SEQ ID NO: 208 - DNA, 1410 bp, Plasmodium falciparum
atgctcattttagttgaaactgctgctggatatggactttttaaagttgagaatagtaaattaattgagtcagatgtaaaagatattgaaaaatgttttgttactagcgaagaagcaagaaaaaatgtatctttgtacagttttagtaaatttaaaaagtttcaaaatgcatttgatgaaaccaataaattaatggaatcaaaattagggaaagggttaaagaaatttttaaaaaagaatataataaaacctaaattgaatgagcccttggctttgtgcgataagactctgggtggattgataaaaaagaaatataatataaatgtaacatatacgaattcaacacaagaaattataagaggaatacgtacgcatttatacgaattattagtaggagtaaatgaggaagattctaaattattaaaattaagtttatcacattcattaaatagatttaaattaaaattcagtgctgataaggtagatgtaatgattgttcaggctgttgggttgttagaagatttagataaagaaattaatgttttttcaatgcgtttaaaagaatggtatggttggcattttcctgagttaggtaaagtaataacagataataaaatatatgctaaatgtgtaaaattgattggttttagaaataatgcaaaaaatgtaaatttattagaagaaacaacagaagaaatacaaaaagaaataaaacaattagctgaaatatctatgggaactgaaatcgaagatgatgatttaaattgtataaatgaattagctgacagattattagaattaacagattatcgtgaatctttagcaacatatttaaaatatagaatgaattctattgcacctaatttaacatatttagtaggtgatttagttggtgcaaaattaattgcaaaagcaggttctttaatgtctctagctaaacatccaagttctactttacaaatactaggttcagaaaaagctctcttcagagccttaaaaaccaaatccaaaacacccaaatatggtcttatatatcatgcaacattagttggacaaaccgctcctaaattaaaaggaagaataagtagatccttggctgctaaattatctttatgtactagagttgacgcactaggtaattttgtagaaccttctatagctattacatgcaaatcgcatttagaaaagagactagaatatatcacaagtaatttacagaaaaaattaagtaacccaaataataacgtcaaagcacaacaacaaggacaacaaaataaatacaatcctaatcaaaaaaatgatggacaaaataatttcaactcttttaataagaggaaaagtgatttcagatttaaaagggaagctgataaaaataacaaaaagtttataaagaagcaaaaaaggaagtaa

SEQ ID NO: 209 - DNA, 831 bp, Plasmodium falciparum
atacgactacgtaaaaccaaaggaggagagatatttcattttaatgacattatggggacacttcttcatgaacttgtacatatagttcatagtcgacatgataaatctttttatgagttactagacaaaataacttgggagtataacgagttatatgtatataataagaagggtatatctggaggagataaggttagtactaatataattaaatataatttgggtagaaataatataatgaaagataatataattctggatattacaaaaatgaataatgtaattagtatttgtgaagagaatcctaagtttatggctgctcaagccgcagaaaaaagactgcttaataattttatgaataatcaaggagagattgtgaatgcatcccttttaagttgtttaactaaagaacaacgtgaaaatttattaaataatagaaaaaaatatgatgatataatttgttgtttagataatgatattattttaatcgatacaatctctgatacatatgataaggaatatgatcataaaagtatggtttctcaaaagaaaagtgataatgtatcatttttagaaaatacaaaagataatataaataataatattgattatacttacatgcaacatttaaatgataatgaacgaaaacaagaaaaaaaagaaaatgaacttatgattacacaaaattataataaccaattcgaaggaaaaccaaatgttatagaaatattgacaccagatataaaaaaaaaaaagaataaaagaaagaacttaattgaatcaaataatggcatttttgatctttcacaaaatgatggtaattatatatga

SEQ ID NO: 210 - DNA, 594 bp, Plasmodium falciparum
atggaagataaagttgaagatgctggatcagcttttgttgatttagataaaatagtaaatgatgattcgaaacagttatttgattttggtgagaagaaaaagaaaaagaagaagaaagaggttgtagaaaaggtagaagagattattatagatggtacagggaaagtttttgaaagaggagctgtatatccatatgatgaattattacatcgaattcaagatttaattaataaacataacatagatttatgtatatctaaaaaatatactattaaacccccacaagtagttcgagttggatcaaaaaaagtagcatggattaattttaaagatatatgtactattatgaatagaaatgaagaacatgttttccattttgttttagcagaattaggaactgaaggatcaatagcaggagaaggacaattagttttaaagggaaagtatggacctaaacatattgaagcactcttaagaaaatatattactgaatatgtaacttgccaaatgtgtaaaagtcctaatacaactatggaaaaggatagtaggacaagactttttcatcagcactgtaatgcttgtggagcaaaaaga

SEQ ID NO: 211 - DNA, 2037 bp, Plasmodium falciparum
ataaaagtacatggatataattattttcctgatattaacttttttgaagatattaagagagctccatatttcttaaccaaattttttacttttgctcagtcctatttaaatttcacatcaaatatatatcgttttattaatttcaaatgtagtgaacatgaagaatttttaaaatattgtaaaaataatatcatgttatataatatgaaaaatcaggtccatttctccaatgtggagacaacacataacagtaataattatgacggacaaataaaggaagatgtatattgtactacagaaaataatgaagtggagaaaaatgaattattaccaagtatgaaaacaaatacatttattgaaccattagaaataaaaaataaaaatgagcatgaaacatccttaaataggaacaattccttaaatattaataatgaatttgtggaaattaatgataacaattttatagatttggataaagaatttgaaacggataatgaaagtgatctagatttggaggatgacgaaggagatgatataatagatatgtataatattaacaataataataataataatattattaatagttataacgatacataccatttagatacaagaaatgatttgatagaattatttgacgaatcatataattatgacaaagaaaatattttagaagataacagtaattatttagataaacaaaatgatatatatgataataaggataaaactttaagaaaagaaatagaaccattacaatcattatcatatgatgaagataatataatttatgatgaaaatataattcttcaaacagtagaaaatggaattattgaaaataataatgttaatttgacgtatgaagaaaataaaatatcttttgaaaaggaagaagaaacaaatgaaaatgtgttaaaaaataataccaacttattagaagtaaataaatcaattaataaaaaaaagaaaaaaaaaaaatgtaaaaaaaataatcaaataataaatagtgatataaatacaccatttttacgaaatgatacaaaaaattatgtgcaaccaattcctttgttaaaaaaatcggttcatagaaatatatcacatgaagatgaaattattttaaaatttatatctgaagaaaatttcagaagatatgaaaaatatgttctagatttcttatctaactactttgaaaaaaacgaaaaccatacaatgaaaagtcaagagtcctctcaagtgattgaagaggaacatgtagaaagttcaaaatgtgaagtaactaatgaagatgctcctagtgacgaagatatatcttatgaagatgattttgaaggagaatttgtaaatctaaaagatcaagaggatgaaatacatatgtttttagatgatgattttgagggtgaatttgtatatttgaaagatgataaaaatgatgaagattatacatatatggatgattatatggatggtaaatattcaaatgtcaaacatcaaaaagatgaagaacgtatatatataaaagatgaaaaaaataaacaagagattgaaaataataaaaataataaaaataataaaaataataaaaataataaaaatacctataaaaaaaattctgataaaaatgataatcctcgtaatgatttaaaaaaatatcgaatgaaagttaaaaaaaaaattgtaaaaaaaattaataaaaattcaaatgttaaaatatacaaaagttcaaaacatgtgaacgaagtcaataataatactttaacaaataataatgaagtaaaacaaaacaatgaatattatgaatctttctttattccaaaaaatttaacagaattcaatttcaaagataatgataaacaattatattatttaatgtcattattaaatgaaatacatgatattttttacataatgttagaacaatttaaacgaaaagaaacaaatgacgaaaatagagatgatcaaatatataactattttttaagatatcctgttgtgcgtacgatattgactcaatatcgaaaacaagttttaaagggt

SEQ ID NO: 212 - DNA, 1992 bp, Plasmodium falciparum
atgaaccttagtgcgaaaatcgattcaaatggatataataataatatagtagaaaaaaatgatgataaaagaataggtagaattatgagcgatgatgaaaatgaaagaaaggatataatatataataatgagaagaataagagaacgtctgaaataaaagttcttaaaaatgatatggataataataaaaacgacaacagtattcaatctaagttatcttttgatataaagaatgtattaacacatgcatatttaccaatatgcttagaaaaaatgaaggagggagaatatgtttataaatggaataataatatatttcaaaagaaaaccttaaaatttttttatttagatgttaataattattgtataagatggaattcaaaaaagaaaaaattaagtgaaaaaaagaacccatccttatatatatgtgatataataaaaatcttagatggttcagaatctttatttttcaaaaagaaagaagatgataagaatttatctattgaaattataagtacacaaagaaatttaagattaacctttttagatatacaaagatggaaaatgtggttatttggtcttatgtattatcaatataaattagttaataaaggaaatgggaaaaaaaaaatgaaatcctttttatatgaaagtaataaattatatgataattatatcatatcaggattaaaagatattaatgcattaacattatctcaattatacattatattgagaagtcttaatatatatttgaatatgcaaatattatatcattatttttctatttataaaaataaagctgttataaattatataggttttacgaaaatattagaacatattttctcaaatacacatatttcgatatattttaatgaatataaagataaaaaatttaattatatagataaaaaaaaatttattgaattcttaatcgatatacaatgtgaaggcaagtgtgaagaatttatatttaataattattatcaaaatgataccaacccaaacttaacgcgtgagaaaaatacagaaaaattagaaagagaaaagaaaaatgatgaagatgatacacattataacttagatatgatgcaatcatctgcacataataataaaatttataatgtaaataatcaaatggacgacatttccataaaatacaaaaatgaagatgatgtaaaacctaaacatatatttaataatgacaataaagaaaattgtaataaggaagaaaataattatagtaaaagtgaaaataatacatatttcaataatgataataataataataataaagtaagaaatgaagccattattaataattatgattgtaatattattaaaaaaataagtaaccaatatataaatcaggatgatataaaatataatatggatatatccaatacattaatattctctgataattctataatacatgatgaagattattttttaatattggatatattaaaaagtaagtacttctatcatgatcaaaataaagtaggtaataaaaaaaacacacatgataataattataataattataataataatagtgctaatgcatcatgtcaccataatttaaaagatgaaaaagaatctaaattaaacagtaataataataataacaataataataataataatgtagatacttgtatcaatgttattaataaaaatataccaaatatatatcccataaaagttaatgttatatataaattattaaatattattaaaaaatataatatcccatttgttataaataatgatgataatcaatatttaactgaaattggtttagtttatttcttattatcaaaagaaaatagtattatgtgcccagagtatgcaaaggtatatcaaaatatgaatttacccttatgtaattactggattaatagtagtcataatagttatttagctagaaaacaaatatttagtacaagtaatatagaacaatatatatatatattattagatggt

SEQ ID NO: 213 - DNA, 2214 bp, Plasmodium falciparum
atgaatcgaatattttatttttgtttgtttactattttgttttggttatctcttgtatctggtgaaaatgttaataataaaaactgtaatgagaaaaataggaaagctattttattagctttattaaaaaattcattagtagataataaggattataacaatagtgaagaattaaagtatgcattggaacatatccagaattctgaattatatccaaaggattcgaaaaaatttgacaaatttattgatgaattttttagttattataatattcatgtaaattttactgatgaagaaaaaagaatattacatatatcaggtgtcttcaaagaattttatgtagatgtagataatttaaataaagatgaaatgaaagaatattttaagaaaaattatgaaaaaggtctttctttaattaatttaatagttcatagtaatttaataattcaacaatttgatcatgatattatagataaaaaaaaagtacatgaacaaaacacaaatacaaataaaactttagaatatatatctgataatttaaatgatctaattaatttcaaaaatattcatttaaataataattccactggagattttattatcaaattatatacaaattatgtgaattatattaacccttatcaaacaaaccctttgccaaatacaccccactattacgaacataaaaattttcatacgaaagaacattatatatacgacgaggaaatagttaatccaaatatggataatataaatacacacactgaagaggataatgtgtatgtatcagctacaaaaggaaatcaaaaagaagaaactgaaaaaaaagaaaatcatgaaaataataatgcaattaatcctaaatatatgaattatgaaacatattataaaaaaatattcaatgccatatttgaacaaatagataaactaaataaaacactttttgaaattaaaaataaaaataacagtgaaacaaatgaaaatatttctgaatcaaattctggaaatccagaattaaacaatgaaaatagctattctgtaaaattgtccagttcgtcacccaattcaactaacaaagaatctttaatctttccatatacttattacaatccatattatatgttcagattaactaataattttaaagaaaatgatgaaggtttaaaaaatgaaaacaatatcaacaataatgaagataaccaaaatgataatatgaacatagttttggggaaaatacataatattttaaaagattttaatattaatgaaaatattatgactaataaaatgtcagcaccacttataatgacaatcattttaaattttttcaaaaaatatatggctgaaaataaatttaatcttccaatgtcatcagaggttgaaaataaaattaacaaatccaataataaagcattattacaacaaagtaataaagatacaccaatacataaaaaaaaagaaattagaaataaaaaaatacaaacaaaagtagacgtaattgatgaaaagacaaaaaaaaaaattgcaaatactatttatgtaaatgttggacaaagtggtattaatggattttttaatttttttgattttagagaaaaatctatagatagcaatatctttgatttgttacatgtaatggaagatatgaaaatatttgatattttccaaactattatatttattcaaaaatttacagaaaatgtatgtgcatcttattgtatgaatattaccgatgtgctagaattatcacactatgatatgatattttatgataaaatggttttccattttagtaaggatggaatgatgataaagacggataaaaaatatttatataatttaaaagaatttgaaaatatacttaatttattaaatataaatgctaataccatagcattaaattgtacttgtaaattttatgtagacgttaattatacatattctgaacaatataaaatgcatttaaaaggatatctccataaaatgaatgaatttgattatattaataatttttcagcatcgtatcttttaaatcaattaataattttccaagataaatttaattatattaaaatgaatggaaaactacctattgatgatccaaaaaatatatataatatgaataatgtacacgatacagcatattatcataattctagatatttcccaaccaaagatatgccaagtttagaagacaatttttatgaacacctt

SEQ ID NO: 214 - DNA, 2208 bp, Plasmodium falciparum
tatttcccaaccaaagatatgccaagtttagaagacaatttttatgaacaccttaaatatcctgatataaatactattcatatttattataatgcttccccagttaaattaaatgaagtgaatgatttaaaaactataattattgatgaaataaaatcgaaaattttctatattaattcttatagagtaggagatcaatttttcccaacttatagtaatttaggaaaggatgatcatgatttagaacattcagcaaaaaatttttataacatatctaatgagaatggcgataatacattcaataataataacaacaatatggataacaagaaacgtatgtataattataataaacataaagataatgatagcagatatacagataattctaacaaaaatagagataattctaacaaaaatagagataattataatagaaacaaagataaaaataacacaaatagggataattacaacagatataaagataataattactattataataatagtgataataataactataatgaaagaaaacgctatattaggaaaaaaacatacaataaattaagttattttaatttaccaagcttaaaatcaatatataataataaaattaagggaaatagtgaagaattctcatttgataatgaattacctgaacaaactgaatcgtttcctttaaataaaccacaagatcatgaagcattttataatttaaaaaaacatcataccaatgtgtatgaaccaaatgatgaagaaaagcaaaatgaacaaaaattgaaggatcaaattaagattacatcagatattttatataaagatattgaagaaaataaaaatacggaagatgtcttattaatagaaactataactattaataatggaactacatcaaatacaattgaaaataataaggatagtaataaggaagcagaaaattctaacactgaacaaaatgataataataacaatgataataataacaacataaataataataataataataatgataataaggaagaggatatgaatgagaacaataataattcaaaagttacaggtgacagtgtagaaaatatcaatgaacaaacaaataataatcaatatccaaacactgaatataataccatacaaagatctattaatgcaaaatatttgattttcttttttaaaaatcttcatgtatggaaaacagatttattttgccagaatataaattatatgaataactacctaaatagtatacaatataataaaactctcacctttgatataaattatgacacaaatgcagtaactatatattttactgataatattacttatactgtaaaagtaaacttagaatatcttgtatttttattagaaaaaatatcattgataacatttgtagaagatttatgttctctctttgatactgataaaaaaagaaattataaaaatttaactgaattcttagaaaatacagaacgtataaatacatttgttagaaatcatatgatgttgtctaatgaacaatttataaataaaaataaatatgctaaggaattagcagaaatatctacatctaatctcttttatcctaaaaaagatattattttaagatccacaccttataacaatattatattagatgaaaaagatatataccaaactatttttatttatatggatgatatgttaacagaaaaaatggtaaatgatacttggattacaccttacgcctttgtagtctattcaaaatccaaaaaagacatgcaaggaaataatattaaaatcgaacaaaataagaatataaccaaatattctagaagtgcaattgataaatatgtgcattatgaatataaaagaatttcagaaaacctaaatcgcttttttatggaatcaaattcaaatgctcctcaatttaatgaaaattataaagaatatacaataattatttataatgataatccatctatgcctaatattgtacttactacaacgattaatgtattcaatgtttctttcttacaaagcataatggaaatgttattaaatattaaagccaaccaacaattcttttcttataaaggaaaattcataccaatcaatgcattcattactttagaaaataaaatcaactacatattctttaactatataccacttgaaaattatgttaataatggagatgcactagattttagaaatccatag

SEQ ID NO: 215 - DNA, 276 bp, Plasmodium falciparum
aatatatgtttaaacgttcccgtctactcccctctggaaataatggtcaaacatttaattttatgcaggaatttattacgtgagaaaaaaggcaatataggtattatttatgattgtagttatgtatgccaaccttataaaagatacatgataaaaataaaaaataacaaaaaaaaaagaagatactttaaagaaacaagtaccaaattaaaaaacgaaaaaaattcactaaatggaaaactcaatgatgataaaagattatctatatttcaataa

SEQ ID NO: 216 - DNA, 1602 bp, Plasmodium falciparum
ggttgcaataagttggccgacgcggttagtgtaacgcttggtccaaaaggaagaaatgttatcatagaacagtcatttggttcacccaaaataacaaaggatggtgtaacagttgctaagagcattgaatttaacaacaagctagctaatcttggtgcacaaatggtaaaacaagttgctgcaaataccaatgataaagcaggtgatggtacaacaacagctacaattttagctagatcaatatttcaacagggttgtaaagcagttgattcaggaatgaacccaatggatttattaagaggtataaataaaggtgtcgaaaaggttttggagtatttaaattcaataaagaaggatgttacaacaacagaagaaattttcaatgtcgcaagtatatcagcaaacggtgataaaaatataggtcaactaattgctgataccatgaaaaaagtaggaaaagaaggaaccattacggttacggaaggaaaaacgctacaacatgaattagaaattgtagaaggtataaaatttgatagaggttatatttctccctactttattaataatagcaaagaccagaaggtagaacttgataaaccatatatacttatacatgaaaaaaaaatatctactgttaaatctttattaccagttttggaacatgtattacaaaaccagtcatccttattagttatagcagaagatgttgatagtgatgcattggctacattaattgtaaataaattgagattaggtttaaaaatatgtgcagtaaaggcaccaggatttggagaacacagaaaagccttgattcatgatatagcagtaatgacaggagcaaaagttattacagaagaaactggattaaaattagatgatccacaagttgtttcttatttaggtaaagcaaaatccataaatgttaccaaagatagtacattaattatggaaggagaaggaaaaaaagaagaaataaatgaaagatgtgaaagtataagaaatgctataaaaatgaatacatcagattatgaaaaagaaaaattacaagaacgtctagctaaaattacaggtggagttgctttaataaaagtaggaggaataagtgaagtagaagttaatgaaattaaagacagaattcaagatgctctttgtgctactaaggctgctgttgaagaaggtattgttccaggtggtggtagtgcattattgtttgcttcgaaagaattagattcagttcaaactgataattatgatcaaagagttggtgttaatattattaaagatgcttgtaaagcaccaattaaacaaattgctgaaaatgctggacatgaaggttcagttgtagcaggaaatattttaaaagaaaaaaattctaatataggttttaatgcgcaagaaggaaaatatgtagatatgattgaatcaggtattattgatccaaccaaagttgttaaaacagctatatcagatgctgcttctatagcatcattaatgacaacaacagaagttgctattgttgattttaaagattccaaaaatgaagaatcatcacaacatatgaattcagttaattctatgggtgatatggggggaatgtattaa

SEQ ID NO: 217 - DNA, 2997 bp, Plasmodium falciparum
atggatgtacaaaaaaaaaaatgcaaaacgtattatttgatagctatactgatatggtttatattaatatcagtagtattatccaggggtgaaataataaacaaacatgttaaaaaaaaggaagggaattataaaaattatgaggacctcgactcggatataaataaaaaaaataattattatgatgacaaacataaaaataagaggcttctaagtgatactaatataaataatgataataatataaataataataataatataaataatgataataatataaataatgataataatataaataatgataataatataaataatgataataatataaataatgataataatataaataatgataataatataaataatgataataatataaataatgataataatataaataatgataatataaataacaataataataataattctctttataataataattctttttataataataattccttttataataataattctctttataataataattatctttataataattacacgcaccccaaacaacaagatggtcataagaaccatccggaagaaaataaaaattacacatatgatgataaaacaaaatttacaaagtttaataaacacaaaaatgaagaattattcacccccaatccccctcttaattatgaaaagcaaacattatcaaaccatcaaaacattaattttgattctactgtggaggaggggaataaggacctgaacaattcaggaaatattataagtcaagaattggaaaaaaaattatcaacagataatcataaggaagaaggagaaaggaagaaagaagaaactaataagaagcatgatatagatacaaataatatggatgataatgaagaaaaaaatatttatgaatattttaataaaaaaacaaaagacaatttcgatggacttatattaaatatatattttacacctaataataatttatatacaaaagtaaaagtaggtgaccaagttttaaagttatcattaaatagtagattagaaggcgtttatgtgtttatgaaagattctcctgcatgttatttagaagatgatgataagagaacttgttataatcctcttatgtcaagaaattctacatggtgtaacaatgatttaatgtgtctccccgctattctaaccaaaccatatgaatgttatgaggatagttctttgaatttagaaaacaaggttcaatatcctaatgtgtattatgattctctaaaatttaacgagactcatattgaagggtcagatgatttagagttcatagacctagtgggtgttcagacaaaatatattagaaataaaaagaagaaaatggatgttaataaaatgatgagtaatgaaaataaaagtatggatcctaaacatgtggaaaataatttacagaataataatattttaaaaagagataatattatcataaaaccaagagttaaattatcagaaaattcaaatcttcttttccaaggtgtagatataaaacttgtagtagatatgactttttataatgactggaatttatttaaagatacggatggtatgtttggtttggctgggaaagaattgagctgtagaaatataagtgcatggaataatattttagaaaacaataattctatatttgctttagatataaatttgccaaatgatgctataaaaacataccccaccccacctgttaatagtgtaggtacattatattatgaatatgatttaaaaaaaaatggagataataaaaaatcgagtgatcaaaatataaataatgtaaaggataatatgatagataacaaaaatgttgatgtgggggttcaaaatataaacgaatttgagacatctagttctgttatacatataggtaattatagtaaagaatatggaaacattatttggtcagaaccacgagaaagaggaggtatattttcagattcttttattcaatttactatatataacctagaagtatgtaataaaaatatatttggtaaatatagtagtaactggcaagccataattgatttgagtagccaatgtttagtactcccaaaaatgttttggttaagtcttatggagtacctcccagtaaataaggatgacgatagatgtataagaaaaaatatgaaccctaataataacaacaacaacaacaaaaacaatgacaataataataacaacaacaaaaacaatgacaataataataacaacaacaaaaacaatgacaataataataacaacaacaaaaacaatgacaataataataacaacaacaaaaacaatgacaataataataacaacaacaaaaacaatgacaataataataacaacaacaaaaacaatgacaataataatggtgataatgtagattatgaagaaaatagcttacccagaatgtgttctgttgatcataggaatagacccttaccaacattaaaatttttcctatcggacaatgacatagtcagtgataataacatttatagttctcctgaatcggaaaataaagggaagaatgaaaagaaaaatgagaaacaagctatttatataccattagataatttaattataaacgataaaaagaataatcaaaattatctatgtgttatacctgatgtacatgatggtaggtcaaccgagaatagcgctagaacaacaaaaccattaattaaatttggtacttatgttttaaataatttttatgtagttgttgatcaagaaaattataaagtaggttttgcaaataaaaaaagctttcatacatcaaatgaaaaatgtacacaaagaactcaatgtataggtgatcaatattatgaaccagcccttaatatctgtgtagatcctgattgttctatatggtatttttatacattgaatgatcaaaccaaaaaatgtgaatccttatcatcaagattttatgtctttataataatcattttgacattattaatactggacatacaatca

SEQ ID NO: 218 - DNA, 1779 bp, Plasmodium falciparum
aaaaaaaaatttataacacaattatcatatgaagaatttaaaaatatgaatttcttatattttgataaagcatatatagatttaaccttaacaaatcctatacggtatagttataatgatcaagtagaaaaatggctaaatgatttcctatgcctaaattgtaatgaacctacaaatataaaagataatatctgctccccatcgaattgtgaactatattttgtaaataaaaatatttttaaaaattataatagaactagtgaaatattattaaaaaaaattatgacattatttataacatctcattataaaaatacacccaatgatattattatgatattggattcgcaacagcaccatttatttattttaataaataaaaataataatcattataataataataatatattggaagatcaaattgacgaactagatatttatggagtgttacattgtgcaatagatggtatcataaataatggaaacgtcaaaaaaactgtaaaattagaagatattattcatttagtaaaaaataataatacgcaaaaggaaaatcctacattggatacaaaggaaataaatgattcaaatgatcaaaaattggaaaagaaagaaaatataaaccaaataaatagtgataatcataaagaactcttaataaatgaatatgaagggaatttaattccttatattatcagtgattattttaattattatttttataattatatcggtatacgtattgtacgtatatctatccatccatctatgcaaaacctaaattatggatctgaattcttaaaaaaggtttgtaattattacaatgaatataattcaaaacaaagacacgacaataacacaaaacaaaaaattaaaataaataataatgatagtaacaattgtggtgatagtaacaattgtggtgatagtaacaattgtgatgatagtaacaattgtgatgataatgtgaaatacagtgaaaatatcatattatttaattgtaatggtaaaaacatttattttgataagaaattaaaacagattgattatataggtacatgctttggattaaccaaaggacttttaatcttctggcaaaaaaataaatttatccctgtttttttaaaacaacaaaaaaatgagataacaggtgaatttagtgttcttatgttaaaagatctaaatgaagatcttaaacatatcatagcaaatttttatacagattttgtaagaagtgttaccaaacttttaccatattcatttaaatatatggaatcctttattgtttttaatttattacataataataattattctataccattaaaacaagacgatgctcctacaatagttaaggatcataataacacagatcatacatataaccataatggacatataaaaaataatctgcataataatcatttttattatgataattatgaagatcaacatttatccttttataataataatctcataaatcaacaaaccattttctacttttttcatactaatgatatatgcagattaaaaagattcgttttagaaggaagaaatttctatgaaatcctatacctattatcgaccatagcaaacctaatattatttaaaaaagtaaaaatagatttgagctttttagaatatacaatattatatgctgtagcatttcaaaaaaaaacacctaaagaaatatcagacgaaatcaaaattaacgtaaatcaaacaaatgcaatctttagaaaaataatacaccgattttataattacatcaag

SEQ ID NO: 219 - DNA, 2112 bp, Plasmodium falciparum
aaatataaatatctagaatcaaaagattatgataaattatgtaaagaagtacctaagtttttttatcttaatattacatttcgaaagaaaacagatcattcaaataatacatattataatgaaaataattttaaacatgtaatagacagtaatgttttgcaattattaatttatccatctttcttttttcaaaataatctagataacgatttaataattaaatccaatggaaatttacaaaaaattaaaaaaaaatcaataatgttttttggtgatgttgataatagtaaagttatattacaaatagtatataataatcaaatattcctttctaaaaaaataaaaataaatcaagtatgtttaaataaaaaaatcatcttaacaagtaaaaataaaaaagaaaatattttcttatctatgaatattacattaaatggtaatatctataatacaaaaacaattactattaataatagatatacaattattaataataccaatcgaactttatatgtgcaagaagttaataaagatttcaaaattattaaaaaaaaggaaaaaaaatatatgacgtattcattttctttagaaaatttacaaaatcaaaataatcattcaaatgatgaaaatatggaaaaattatatatacctagtagtaatgatcttactaatataaaacgtaattataatcaaaaagaaaaaaatgaaaaaaatgaaaaaaaagaaaaaaatgaaaatttaaacaaaattacaatcaataaacgatcagatttaacgtatgagcacgaaaatgatgaaacaaaaattatggatacttgtgaaatttctgataagaaatatacggaaaaaggtatgacaaaaatatgtgaatttaataaaaagcatataaaatataataaacataaaaaatataacgacaagaaatataatcaaaaggaaaacaataataataataataatactacgagtagtaataatagtaatagtaatagtaatagtagtaacaacagacctaatattatttcaataaaaccatatgaatctttttattatcatcctattaacacaaataaatgcttcctaactttttcttatacaaatattatggaatgtaaaaatgataagaatttttatagaagaagaggtagctatgaatttacacatacacaaaatgaaatcacaaacttattcaataattatttaaaaaaaaaaattatgaaatctcaaaatatatctataataaatgataaagaagaaaacataaataataatgtacataaaaatcaagaattctataatttattttatactagtcctatagaaatcgaaaaggtaggtaattacaaaatttttcacaagacagtacataaaattgatgttacgtacaataatgaaaaagacgcaaccgacgatcaacctacatatgaggatgatattattcaaaaggaaataaaacaacaagaaaaagaaattgaagaagaaataaaaagagaaatagaagaactagaagaacatcgtgaaaaggaaactattattgtattttcaaatttgaaagattcatatgaaaaagaaatgcaaaaaaaaaaaaaagatcgacataagaaaaataactttcttaatataaactctgatcatattaatgataagaacattattaattcttataaaaatgaacaaaccactgaaatgatatatatacaacacgactatacagataatatacctgctgacgatgagaaaaaaagttcgcataatgaaactatacttatagatgatttaacattatttaataaaaataataaacatagtattaatgaaagggaaaataaagaaaacatatttaatgaaacggttttgacagtcgataataatgatactgaacatataaaaagcgactatgtaaatataaaaggcgattgtataaatataaaaggcgattgtataaatataaaaggcgattatgtaaatataaaagataattgggtagatataaaagataattgtgtaaatataaaagataattgtgtaaatataaaagataattgtgtaaatataaaaggcaattgtgtaaatacaaaggaggattctcataataattatcaacagaatgat

SEQ ID NO: 220 - DNA, 2154 bp, Plasmodium falciparum
aaaaaaaacagatatgatgatgacaaggacattaacgattacacaacaaaatacaacagaaaaaacaacaaaaaaaacaacagaaaaaacaacaaaaaaaacaacagaaaaaacaacagaaaaaacaacaaaaataatgataataacaatattaatagtatgtatggtagtcattataataataattatatttattataacgattattattataataataattacatgtatcgtcgtagtactcttaattatcattattatgaacaaggttatgataaatacaaattgaatcgtatatataataataacccgaaattaagaaaaaataataaagaaagaaaaaataatatacaacaaattaattatacaaccaaaaaagaagacaaacataatttcctaaatttaatagatcaatccagggaaagctcatttttagatgagaaagatgattccttaaccaatgatgataaatatattatgcatctactaaatgattataattcttcttatcaaaataatttattaagtgaagaagaatcttttgttaaaaggaatttcagctggaacttttttaaaaaacaacatacaaataataataataataattcggatgatgacaattattttaatgattcatataataacataaaacatgaaagttcggggaacttaaattatatgtacacaaaaagtattaaaaataaagatttacataaactagtaattgatgataataactcttctatgaattcattcctttttaataataaaaaaaatgttatcatattagatcaagtttctaaaaaaaagaaaaagaaattacaatatatcaaaaattttgaagaaccacaaaagggacatatatatatggatgatgacatgtatatagatgtagatgtagatctaaattcttatgcggaaggaaaaaatactacaaaagatacatccaaatatccaccacattttaaaatatcatatgatgaagaaaaaaaaaaaaggaaaaagaaaaggctttcaaccggtagtaataataatagatacaaaaatgatgcggaaatattagatatgaatccaaacaaaaaaaacaagaaaaaaaataaaatgctaaaaaataataataataataataataataataaaaataaaaaaaataaaagaaataataaaagaagtggttgtactaaaatgttcagattttttaaaaaaataggattaaatattatttatattttttcaaaaactaagagaatatgtattggtatatatgtattatttatacaattaatattatccttattattttctattacactaatattacaatctttaataaatttagtagaaaaggtaaatataaataatgcagataatgtgtttttaatatttaataaaaaatatgaaagaaaaaaagtagtggtatttaataatatagaggaatataataaatttaatattaccaaattattttattattatattagtatatatatgaatatagtgaatttcttatattataatatgttatataaaatgaagaagaaaaaaaaagatttatcgggagaagataaaatttttatgaagaaattaaaaatcaatttaaaaaataaaagaaaattttctttctttattaatttctttttaaatatatttaatatcatcaatatattattatttggacatatagttttcttacttttatgtttattaacaatgaataatatttttcaaaaaatacttacagcatgtattaaattagtatattaccaaagaaataaaaattatctagattttctcaataaaaacagttttaatcatatgaatattataagttatattaaaattaatcaagttataagtaaatatgtactattaaaagaacccttcaaatatttcttatctcatcaagatttcttggatattaaagcacctaaaaaaagaaattattttgtatataccaaagagctcttcttttatatacaagaaaataaaattgtattcttatttagaaaaaacgatatgaaaaaaattgacattattatacatactataaataatagtttcgcaataaatagttactataagaaaaagggtagtaagacagccaaaaaaagtagatccaaaaataccccatcgaattatactcttaatatggaa

SEQ ID NO: 221 - DNA, 2328 bp, Plasmodium falciparum
gaaaatatcatcaactatcaaggcatgtataatatgaataatatttataatacaaataataatatggaacaaaataccaataataataatatgtataaccataattcatatgccaattataaacacgaacacttatcattgaatgtctacgaaggaccattagagaaaaataacgaatggggaaaaaagaaaatgaataaaaaaaacaaccaaagtggtatgaaccaacagaatgttatgaaccaacaaaaagttatgaaccaaccaaatgctatgaacttccccaataatatgaaccaccccaataatatgaaccaccccaataatatgaaccaccccaataatatgaaccaccccaataatatgaaccaccccaataatatgaaccaccccaataatatgaaccaccccaataatatgaatcacctcaataatatgaaccaccccaataatataaatcagccaaatttaataaattatcaataccccatgaatcatgtacagcacatcaatcatcctgataatagaaacaaaatgaataatcctaatattcctaattacccaaatgtcaacgtttctgctcctgaaacaaaacaagacaccaaaataattcctaataaagaaaagaaaaaaattataaataatgaaggaacagtacttcaacccttaaaaaataatgtagagcataataaggcgaataatttattaacttctaaaaagcacaacacgaatgtaaataataagaaaaaatctaagaatgttcaacaagaaacccccataaagcatcttccgaatgaggaagaaaatatgaaacaaggaaaaacaaaaaacagcaacaacaaaaacaacaacaacaaaaacaacaaaaacaaaaacaacaacaacaataataataataataatttggagagtatcacgaaaaacaaaaataattcacaatacatttcaacaaatgtagaaaatgaaaatttaaataaaaatgaacaaaagggaaaaatgaacaaaatgaaaacaaagacacaacgttttaataaagaagaacaaaatgaaacgaacaattttacaaataataataaaaaaggatctaatcgttatcaacaaaataaaaaaggacaatttaaaaattctaatatgaactacaattcatggataaataatcagcaaggaaatgatcaacaacatttgaatacaaatgtagataaggataaaaataaagattttgaagtgaatcatgaaattcataagtttattgattattgtttaaaaaattatggaaatagaaatataatggatgtcttaaatgaattctcatcatcaaatggaatgaatgaaaattttgatgaattgaaaaatatatttcaaatacaattaaatgaagaaaattttaatgcccttgcagcattagaaaatgaagctcaaacaaataaatttcattttataaatgaaaagaatatgaatgaaaccatagaaaagggtattgaggaaatttttgaagatacaaataaggatataattgaggaatatgataaatttaaaaaaatgttgagtgaaagcatggatgaaagttcaatgagaaaaatacaaatagaaaataaagaaataagtgacaataaagaaataagtgacaataaagaaataagtgataataaagaaataagtgataataaaaaaataagtgataataaagaaataaacgataataaagaaataaacgataatgaaaaaataaacgataataaaaaaataaacgataataaagacaacaatgaaaagattgaagaaaagaaagaacttgttgaaaacaatacaaaaaatatgtttgaagaaaataacaaaattaatataaccatacccccaggtttaagtttaccagatattaacagagctttattgcatagtgcttatttagataatataacagtagtaaaaaagtgtcttgaaaaaaaagcagatattaattatttagacaaaattggaagaagtgctttacattatgcatgtgcaggtggatattttgatatttgtgaattgttaataaaaaatggtgcaaaagtaaatgtatctgactacaaaaattggacacctttacatattgcaattacaaagatgcataaagatataactgaattgttattaaaaaatgatgcaaatatacatgctttattaccacattctttatcacctaatagaggaaaaacaaccgctagtatgggtatccattttgctgctattaaaggtaataaagaaataaccaaattattattacaatatggagctaaaattgatgacacagatttatctaatagaagtgctcttcattatgctgta

SEQ ID NO: 222 - DNA, 1542 bp, Plasmodium falciparum
atgaacaaaaaacataataacagcgcacattttgaaaagttcccatgcacaactaatattccttacagtgttcagaataacttcaatttagaaaaagatacattaataaaaaattttgaagataagaatgaacatataaacaaaaagagttttaataaaaatttgggaaacttaatatataatatctcaaaacttatattacataattcaaacaataacaattctgacggtaataatattaatagcaaaaatagtgatactaaccataatataacaaataacaaaagctcgaataataacacaactaaccataatactacaaatcatagcataaccaataaaaatattaccaaccataacattgccaaccctaataataataatcctaacgataatcctaaaaataattataaggataaaaacaacaataaaaacaacaataaaaataacaataaaaataataataaaaataataataaaaataataataaaaataacaataaaaataacaataacaataaaaataaccttaatagtaatattacatgcagtgaatacaatttactgagtacaaataaaaaaaatcaagacatcacacaagcattaggggatcatataacatcaatcacaatgaataatatagaaagtaataactttttagttggtgatgaaaataatggtttttatcaaattttaaacaatgtagattataataaaaaggagaagaagaagaattttataaacaacaaatgtaatagtaatatacatatgaataatattgaaaaccaattatataataatgttaataatataattccaatggtttcaaaaaataaatataatttatttacaaataacgaaaattataatcaagagaatgataaatataatgaaaaattatttaacaattcagttaacttttgtaatattccaaattatgaacaagaaaagaaaaaaaaagaaatagaaggatcagaaaattataaaatgaatgatgtatctcaacttacgcaaatgaattatatgtatagaaatatagattattctaaagaaaaagtagaagaagaatcttttgaaaaaaatgttgtagattttgaagaaaatgtacctgaattcatgaatgaatataaattatataatgaaaaagtgaaacatgataatataaataatcaaatcattaaagaaataaaaaaaaacaaaggaaattataattttaaaaatattgtaataactaatattttccttggaaatatcccaccaaatatcactgaagaaagattaaaaaatgtattagaaatatttggatatataattcatattgaatataaatggtctattgataaatggtcttatgcttttgtatatttcattgatgaaaaatgtgctattaatgctgttaattttttaaatcagaaaaagttttttgataattcacctaatcataaattaatatgttttattgtttccaaacaaattcctcatcaaaataccatgcattatagtaaagaaaatttctccttgttaaaagatggaccaccaggc

SEQ ID NO: 223 - DNA, 2742 bp, Plasmodium falciparum
ggcgcaaatttatttttatatggaatacccctaaaatggaccgaattaaatttaatacagctagtaaataaatacggacatgttgtaggtctaagaattccgtatatcagtaaagagaatgacaagaaacaaggtaatagaggttttggatttgtttcttatgataacaaaaaatcagctatagaagcttttgaagaattatcaaaaatgtatatacatggaaaacttttaaaggttcagttaaaaaatggtgaagagcatttattacctgcaaaattaaaaaacatttataatacaaataaaaataaagcaaaagatgttacaaacctgaaaaccgcacaaagtttagttagtacaacggatactttaaatacgtttaattctttgacttcaaccgaagtaaaaaagaaacttaaaaataacaagtgttcaaataataatatgaaatcttccgtttttatttcaaataaaaataatataaataataataataataatagtactatatataataaagctaataatagtaatactcaacatctttcaattcctgatacgaatagctcaaaaagtttattagaaaacgaatacaaaaataagtttcctttaaacaattcgaataattgtgattccgttcctagtatatatccaaagatgtttacaaattattcggataaatatgatctaaatgttaccactgaaaagcattttcctatatatgcatctaaattaccacaaaataacggcgccaatttgtgtttatcaaaagaattgaatacaggaggagaattttgttcatatactattaatgaaaataactcatttgaaggaaaagatactaataaaaagaattgtggaaaaatgttaaaggaagcagatgatattaataaaaatgaaacattttttttaattaaagaaaacagagaaaataaatatagtaataataaagacaataaaggggaacaaataaatactcaaaatgatatggcgttatataataatatggaaagtaatatgataacttataaaaatatggaagaaaatatggtacctaataaaaacatggaaactaccttttcatactttaatatgtgtgataataataataataataataataatagtaaaagtaattatagtgactccaaaaaagtaactccaaatagtaatagtaatagtaatagtaacagtagtagtagtagtaatagtagtagtagtaataataaccattttgaaaagagatgggataaaaatacctggaaaaaaacaagcaatatacaatcagtagaagaaaataacaaacatgataatacgttttttaattttatagataaaatggatactacaagatgccaaggaggaaatataagaaataataagtattcaaattataattacatagaagagaataattctgaaaagaatgaatcatctaaattaaacaatttcaaaaaccaatttggtgcaaactcgaaaaatttgtttttttttaataattcaaatgaatcagaaaattcaaatattaatatgtataataaattttttgttaatgaaaataatttatattcagtagatgaaaaaaatgaaagacaaaatatacctacagaaaaaaatattgagctaactataaataggataaggaatgaaacaccatcatcatttaatgaaaagacaaaaaatataagttcctttttaaatgatatatggtataacaatggtaataataatattattatgtacaataaaaatagtaatgtacatgataataataataataataatattattcataatagtaatagcatgcattatcatataaatgatatccataccaatatgaaaagagataactacgagaataataataagtggaataataatataaagggaaataattcaaatgaatataattataaaaaagaaaacaataataataataatatgttttattataatataaataataacaataataataataataataataataataataataataataatagtgagcatatatctgaaatagatgttaaacaattaaataatattatggaaaaaaagaaggaatatttaaatgctgtttctaaagaagaacaagaaaatttggatgataatatatccaaaaatgaatatatgaatgataaacaaaataaaacaacacaatattttaaaaatatgaaaattttatttacatttttaaatatatatgcaaaacagaattcattagatatagatgatttttttaatgatgaaaaaaatatgcacttgtttgaaatgttaattaataagaaacaatttgataaaaatgatttggaatatttatttaatatgttacaattaaaaaataatgaaaaggaaaaaatgaaaaaagaaatattaaatcataatgaatatttcaaggaaaattataaccatgataaaatagtatatacaaaatcaaataccaatatgcttaatatgaattataacactcccaataggtaccagcaaggtaataatattaatactaatcctaatgttgctcaaaggaatgaaaacaactattatgggaaaaataatgatgcaccatatgatttagatataaataacataatatatacaagtaataattttacaaatttagataaatatgaaaatagcaacttcaatatggaaataaaaaaaattaatgatatgaatgcatacgataataagtttataccaaatgttcagaataatgtcaataaatatatgtaa

SEQ ID NO: 224 - DNA, 720 bp, Plasmodium falciparum
cagtcgtccaaattaattggtatttcaattttccaattatacacaaataaactcaattacaaaaattattccatggtcgttatcctatttaatattttacttaaattatgcagttttatttttctgtataataacaagaatacctacgtgagtccctttttatttttattcaatataattgttcagaatatttctatcaaaattttatctttacccatcttattattatgtatagaaaaagctcctttaagtttagaatctaccataataaatatatatattttttgttttaatttatcaaatttgattagtaaaagatatttcatgtggaatattattttacatgtgtcaaagaatgtgttcataattttacttctttcattcctaacaacctgtgctagcttattatattatttccacatctctttagataccttaaataatatgaattcatcatcattatatttagatgaaaaggaagatgtaaacttgaaaataaataaaataccccaaaaaaattatttgcgtgatgaattatttcttaataatgaggaaaaaaaaaaacaggttaaaaaagttgttcgttttaaagaagattcaattataaagacgcaaaaaaatacaaatgatgaaaaaaagaaaaaaaacaataatttatttaaaatatcatctgattataattcagatagtgatcagtggttgataattgatagtttaaag

SEQ ID NO: 225 - DNA, 2892 bp, Plasmodium falciparum
gaggaaagtaaaatgttttttaatatcgaaaatgaatataaagaaatcatacatagtgcagcagaacaaaaaaatgttttacaagtatgtcttaatgaagatttattctatttattaagcaaattttttaaaaatattgaattgtgtgaaaaagctttaaatgattatttagatcaaaagaaaaaagctttcccacgtttttacttcttatctaatattgctttgttggatatattaagtaatggaaaaaaccctttcaaaatactcccttatataaatgatgtatttaatgctataaaaaccatacaatttaaggaggaccttgttcagagggggcctgtgtcggaactaaatgaacaaaatgaagagaatgatttggtaaagaatgaggaaagaagtgaaacccaaaaggaccaaaaggaccaaaaggaccaaaaggaccaaaaggatcaaaaggatcaaaaggatcaaaaggaccaaaaggatcaaaaggatcaaaaggatcaaaaggatcaaaaggatcaaaaggatcaaaaggatcaaaaggatcaaaaggaccaaaagaatgttaacacagatggtaaaatggatggttatacagatgacaaaatgaatggttatacaaatgatgcctcatattatgggcaagaggaagacgaaacatatgagggtgaaaataaaaaatgcaaagatatcaaaacgtgtgaatccaaagattatatagctaaaggtgtttatagtgtcgaaaatgaacatttagaatttttgaacgaactggttttaaaaggaaatgtggaaaattatttgaaagatttggaaactcatttaaaagtaacaattagaagtatattagaaaatgcaaaaatatgttcagaaaatttagatgaacagaatagagatgagactatgataacgaattatattagtcaagtagtatgtacatgtaatcaaattattgtaacagaagaaataaataaatgttttgatgaattagaaaatggaaatgaatcagcttttgtagattataaaaaggtattaattgagagaattaataaattaataaaattagttgaaaaaacagatgattataatataagaacgaaattattatctttaattatattagatgtacatacaagagatgttataatatcatttataaaaaaaaaaatttccgatagtacttcttttgattggcaagcacaattaaaatattattgggtttatgataaaaaaattaataattatacatgtgaaattaaattatgtgattttaaaacgaaatatctatatgaatatataggaaattcaggaaaattagtaataacccctttaacagataaatgttatattacattaacacaagcattaaatttaatattaggaggtgcaccagcaggtccggctggtactgggaaaacagaaactacaaaggatttatctaaagccattggaatagctatatttatatttaattgtagtaaccaaatgaattattttaatatgtctcaaatatgtataggtttatcgcaaacaggagcttggggatgttttgatgaatttaatagaataagtatagaggtattatcagttgttagtactcaaattaaatgtatatttgatgctattaaagagaaaaaaaccatgtttcattttattgatgatgaaatagtattaaagaaaacatgtggattctttataactatgaatcctggatatgcaggaagaaccgaactacctgaaaatttaaaaaatttatttagatcatgttcaatgattgtacctgatatcaaatttatttgtgaaaatatgttaatgtcttttggatttattaaagcaaataaattatcttataaatttgttgagttatatcaattatgtaaagaattgttacaaaaaaatattcattatgattggggattaagagctgttaaagtagtattaatacaagctggaaacttaaaaagaaaatatgctaacttcgatgaagaaattattttaatgaaagctttaaaagattttaacatacctaaaattacatatgaagatatacctatatttttaggattaattaatgatctctttcctaatgttaattgtaatatattcgatgaaaaagatcaagaaaaagaaaatgattatgatgaagaacataaacaagaacaacaaacatatattatacaagatgaggaaaaaaaattatataaaaagaaaaaaaatattcatcataatatagataaatataaaagtagcatcacacaaaattttacaaatgcaaatgataacaaaaatcatttatcaattaataaagataattatgaaacgaataaaaatttactcacacattatcaacatgatatttgtgaagatatctcccaaatagataaaactaaaaaggatgtacaaatatacgatgaagcacataatgaaaaaagtgatataaatgaattaaatcaaaaaacaaatataatagctaatcaaaatgttaatgaaaattatataaataataaagaatatgataaagattcaaataaaatagataatttaaaacagaacaaatttatgaacgaagaaaaaagaatcattattcacaattttgatgatgccataaaaatatgtttgaaagaatcaaatttacaaatagatgataatttcatacttaaagttaaacaactcaaggatttaatggatgtaagacattgtgtatttatattgggagaagacgggtgtgggaaatctagtgtcatagatattttaattaaaagtttaaataaaataaatgaaaaatgtttatatgaaattataaatcctaaatctattgaatcatatgaactttatggatatttaacaaaaaacaatgaatggattgatggtgctttatcatcaattatg

SEQ ID NO: 226 - DNA, 2892 bp, Plasmodium falciparum
ggatatttaacaaaaaacaatgaatggattgatggtgctttatcatcaattatgagaaaaatgtctagaaatattagtccatataatgaaaatataaaacataaaataactttattagatggtaatatagatgctgaatggatagaaagtatgaatactgtaatggatgataataaagtattaacattagtaagtaatgaaagaataccctttactaaagaaatgcacttattttttgaaatcacaaatatgaaatatgcatcacctgctactgttagtagaggtggagttctttttattaataaaggagatattagttataaattatttataagttcatggattaatttgttaaataataatatcgcaaaaacggaattttattatctattcaatattttctattcacaaaatatagacatgttaagaaaacaatgtaaatttgcttttgatctttcaaacttagatattgtaaaatctatatgtaattatattgattatttcttgtataaatatgaaaaatatattaatgaagtcataaaaaaaatcgaaaacaaacaaaatgaagaaataacctttatgaaaaatgaaaataatagagaagacttatcgaattccaacatgaaaagaaaagataaaacaacaaaagataaagatacaaaagaaataaatgatattcataataaagatataaaaacacatgaaaaaggatctcaaaaaatggacaaaaaaacaaattctttcaaagataaaataataacaaatgataatgaatctaaattaaaacatcaaaaaaatatgaatcatgtagatgatataaaaatgaatacaaaaaatttaataaataatgaagaaaaaaatataataaataaaattaattataattatgaaatattaaaagattattataattgtttttttatgaactcgtacatgtgggtaataaacaatttgataatagatgataaaattatgaattcgaaaaatatatttagtaacaatattaaaagtaatttaaaggtaaaaatggggaatgactattgttgtaattatatatataatatatatgaaaataattggaaacacttgagcgaatatttagatgaagatattttatttcttcagaaattaaaatggaaaacttctgagatggaaaatgaggaaaagggctatgaacatgaagtggtactagagggtgatgaagatgacaatatggatgatgcaaatgaaaatatggatgatgcaaatgaaaatatggatgatacaaatgaaaatatggatgaaacaaatgaaaatatggatgaaacaaatgaaaatatggatgacacaaatgaaaatgtggatgatatacatgacaatatggatgacacacatgacaatatggatgaaaagaaaaagaaaaagttaataaaaaataagaaaaagaaaaaaaaggcaattaataactatattgaaaatatgttaccaaataattatgatgatatatatataaacaccatagaattaataagaattgaaaaaatgataaaatattgtttagaaagaaatcaagcaatattagtatatggaaataatggtacaggaaaaacgaaatgtattaagaataatataaatatgaatattgaaaagtttactcatacaattataagtataaattattatacaaattcattcgtactacaaaaaatcatagaaaataatgtggaaaaaagaaatacaagaacctatggtcctcctaatcaaaagaaacacatattttttctagaggatttaaatataactgccaaagacaattgtgatactcaacagacattagaatttttaagacaattattaacatataaattaatatatgatagagataacttagatgaaaagaaatttattcatgatatatcctttataggaactattaataataatacaaacaaacttatagataaaagaattcagaataaatttagtataataaatattgatgatataagtatgaaaacatttgaaaatatatataaaataatattaaaacaacatttacttaaatttgatgattctataaaatgtttattaaataatattatatcattttcttatgatttatatactaatataacagagaatatatcatttaatttgtctaatctagctcctcattatttatttaatttgaatgatatacatacaatattttataatataataaaatgtactaatccagatatatataataatcaatttaaatttcttatgattgtatttcatgaaatgcagcatgcatatataaataagttaatatctgatgatcatataaatatttttactcaattatttaataaattagttcagcaatatttcccattctttaaagaagattttgaaaaacatatagatatgtttgatagtactaatgagccacataatgttgaacatggtcaggatattacatctaataagtctttaacatttcatgaaaatgataatgttgatgatgatacatataataataatatggataatggcttcaaaaatgacagaaatgttaataataataatattgatggtgatgataatggtgatggtattaatgttagaaccgttgaaaaaactcatttagacatgtcaaataatctaaataattcaaatgataaagacaatattatgaaaatgaaaaaaagtaataatattaacacagatagttacaataataataatattaatgtgaaggtaaaagaaaaaaatttaatatatgatttaaacaaaaatatttttacatcttttatatctattagaaatggattagataaaatgtatctaaatgtaaaaaaattttatgtattaaaagaagtattaacagaaaaattgaatgaatataatactacacatgtagaatta

SEQ ID NO: 227 - DNA, 2334 bp, Plasmodium falciparum
ttatattcaaatggaaaacaagaagatactgacatgaaggttgttcaagcgtctgatggtatgattactaataacaacatgatgatacacaataataacaatagtgattttcttcatgtacaaacgaaaaagataaaagataataattattataatatgttattaaatgtatggcctgaacaagttaaaaacattgttagaaaacatccaggttttgatgttgctctcgtatctgaagaagattatttgaataacataaataatgaagatgattattatgttgataatgaacaaaacaatgatatttttaattatgatgataaaaataataatggacatggatatatcttcttaatcttgttaaacaaaaacttttttgttgatgagtttatgaaaagttcaaattatgaacaagccaaaaaaaattacttctgtgataaaataaaagaaataatggaagatttggaaaaattattggatgatttgaagcataaatattgtcctgttgacgacaacaacaatgataataataataatcatgatgataaccatgatgatgataaccatgatgatgataaccatgatgatgatgaccatgatgataatttgccaactgaacgtccggttgctaccttttacaattatcttacggataaatcgaattataaaaaaataaatcctcatgttcttggagagattgctggaattacgaaacatctaagatgtgaagattttcctaatatttcagatagatgtgttaataatatttctatacatcataaatatggaggttggtttgaatttggtggcgccatccatctaaagaacatgaattatgttgaacctacatatgaacaacatgatgatattatgaaagaaacattcgaagaagttatattagctcaagcaaattgtaaatgtcaaagtattggattgtggagagatatacctgaaaaagatatgtctgaatatagatatcctttgaatgttttcgttttagaaaatccaaaatataatttattgaacttacaagatatacatccatatcttgttgttgatatattaaataaaggattgcatgcaatgaaagcatatgctagcggtaaaatgtataatattgtaacaccgaaggacatatcaaataataatgatgaagaagataatatgtcgaatgaaaataatactacctatgcttacctaaatgattaccatagtgatagtacccatgttcccgatgaagataatgaagcacaagatgaagaagatgaaaaacaagaaatagaagacgatgaagaagaaaaagaagacgatgaggaagaaaaagaagaagagacaacttcacaaccaaaagatgttgatgataatggaccaaatgatccattttacgatggaacattcaacgttttaaataaagaaaatgtacaaacaacttcacaaccaaaagatgttgatgataatggaccaaatgatccattttacgatggaacattcaacgttttaaataaagaaaatgtacaaacaacttcacaaccaaaagatgttgatgataatggaccaaatgatccattttacgatggaacattcaacgttttaaataaagaaaatgtacaaacaacttcacaaccaaaagatgttgatgataatggaccaaacgatccattttacgatggaacattcaacgttttaaataaagaaaatgtacaaacaacttcacaaccaaaagatgttgatgataatggaccaaacgatccattttatgacggaacattcaacgttttaaataaagaaaatgtacaaacaacttcacaaccaaaagatgttgatgataatggaccaaacgatccattttatgacggaacattcaacgttttaaataatgatattaaagagaatgagcaagatgcagatattatagctcaaggttcaagtggtcaaacacaagaatatataaaagacgtagaaaataatgtagaacgaaataatgaaaacaatattaaaaaaaagaatattgataataatgataataatgataataatgacgacgacgatgatgatgatgatgatgatgatagtacaaataaaaatggaaatttattaaaaggtacaatatcggataatcaagtaacaagcaattttagggagaaattatttatatttataatactttgtttaatatctgtatgccttgctttattagtaagtattgctataaaggtatatgcatctgttatgaaaaaaaaaataggtgataagcatgatgttgttttatcctttaaggatagagaagaaattcctgttgtttccggaataccagctccatggttaagttcttaa

SEQ ID NO: 228 - DNA, 729 bp, Plasmodium falciparum
gtgcatataggtacaaaaaatttagagaacaagatgaaaagatacgtttatacgagagcaaaggatggtgtacatattataaacttagcgaagacatatgagaaattacagcttgctgcacgaattatcgtagctataagcaacccagcagatgtagtagttgtatcagcaagaccttttggaagtagagctgtgttaaaatttgctcagtatacaggagcacaagccatagccggtagatggactcctggtatgttaacaaatcaaattatccaaaaatttacagaaccaagattattaattgtaacggatccaagaacagatgcacaatcggttaaagaatctgcatatgcaaatatccctgtaatagcattatgtgattcagattctcctttagaacacgtagatattgcaataccatgtaataataaaggaaaagaatccattgcacttatgtattggttattagctcaagaagtattatatttaaagggtgttattccaagatcagaaccctggaatgtaatggttgacatgtttttatggagagacccagaacaatttgaattaaaaaatctagctaatgaagaaaatacaccaaccgctccacatttaattgaaaatcaatatgccgctgaagctccttatgatgaatggaccaagaaagaagaatggaatgataatacaaatgaggattggaaaaatccaatagccgctgaagagtggtaa

SEQ ID NO: 229 - DNA, 2601 bp, Plasmodium falciparum
atggatgactctttaaacaagctgcaagataaattaagaaaagaaagaaccaatgctcagttcattttaaataaatgtaattttaatattattgaacgatatgaagattcatcgagtgaagaagaaaatgaatttgaaaataataatagtaaaggaaagagcgatttaaaaaataatgatgaagaaaataatagcttatataatcaaaagaaggataatatattgaatgataacaacaataacgaaaatactgtaagtaaaaaccaaagctctacaaataatcaggcatatacaacatataataattataaatatttaaataataatgttagcttccctttagctttacatagaagtatattaaatttacaaaaaaataataaaaatgaaaaactacagaaagtacaaatttgtgaaaataaagaagtcaccattaataagaataataataataataattaccaaaaaaatagaatcaattataacaatattattaatcttaaaaagaacgtgaaatataacgataataattctgatgaacacatttttatgaatgcaaaaaaaatatatataaatgaaaaatatcaagatgatgcacaaagcaaatacaaccttacctttcaacttaacaaaaatgaagtagcaaaactcgaatggaccaatccagtcaaagatgatgaaataagaatcataaaaaacatacaagaaattaaattacatgaaatacgttttgattttcaaggaaaactaagaattcaaataaatgaaaaattatataatgaaaaagaaaataaaataatattcaatcattttaatggattatatcatcataatgaagaacccttaaatagcggatatacactccctgaaatattatatttgtgtcaaagttcttataataatcaagtttgtatttcattaaaaattttaaaacatgtttttataaatatgcacatgaaattattatatatatatcctgcatttcaaaatatttttaattccaattttatgaaaaataaatattcttatggatttacttataaacgatttattaattatattaataatgatttaaaaatattcgaaaaattacttattatttttaattattattataataaaaatgtagaaataaattgtctacatgccttagctagctatttatttccaaataatattttccaaataaatgataatgtactatttaatgaaaatatggacacaaataataaacaagaaaaatataattacatattctttcaagattatcaattattttcttatctaaatttttttagtgatctcgccttttttgtcgatggatataatatctatttttactcaaacaaaaaatataaaatcaaaaattttaaattctctaatgttaataataaaaatggttttggtcataatattctgaacaagtcaggtcaaaaggaggatcagaatattgaagaggatattcctgatgatttggaagatcagatgggggatatatattttttggatgaaaataatgatatatatgaaacaaaaataaatgaagtcgataagaatgatgtattgaatggtaataatgatatatcgaatggtaataatgatatatcgaatggtaataatgatatatcgaatggtaataatgatatatcaaatggtaataatgatatatcgaatggtaataatgatatatcaaatggtaataatgatatatcaaatggtaataatgatatatcgaatgataataatgagacggttcataatttttcgaattttttaaaaagatatagagaaaaggatagctcgatgttattaaaagaaggagaaaatggtattaatgatttatatattaataaaataaaaagatggaatacaaaaaaaaaaaaacaaattaatgataaaaatgtagatataaatgcaagttatataaataagaatagtcctgtggataatgaccccattatacataatgaccctactagtaaaccaaataataaaaatttaatgtcattttttgaatatatggatacaattaattatgatcctttaaaaattagaaacctcaattttgaaatgataaaatattgttatatgaacaaatataattataataaaatattaaataatataaataatatattaacaaataattttgctattttagaaatagaaaatagttgtgtatgctttttaattggattattaattaagaaaaaacaagaaataaatatattaaaaaatagtgatttaataaaaaatatagaaaaaatattagaatccaaaatggttggaacagatttatatcaagaaagattaaataaacaaaacaataataaaaataatttattatattcacatgaagacatatttataaatcctatacatataaattttatttataatttgattacattaataaaatatattattatatataattatgataaggaaatattaaataaaatagacatattaccatttctgatgttcttccgaaccctaccattttttattaacaataaaaataaagagaaagatataaatgaaaatataaatgtaagcacacataaaaatattaaaacaaatacacacaccaataaatat

SEQ ID NO: 230 - DNA, 2178 bp, Plasmodium falciparum
gcgacgaataataatgataataataatgataataataatgatagtagttcttatgacaaaagtataacgatcagcagaagcagtagctgtaataatagccatttgagttatagtagttttgataataatcatggaaatgaaaaaatgaaagattatataagtgttgatgaaaataataataataataataataataataataataataataataataataataaaaataataatgtattgttaactttacaaaggaacagtgatgatgaaaatggtaaagataaagataatgaaaaaaatgacgtaagtttagaaaacaatatggaaaagaattataaagaagaaatatggaattattatacaaaaaataaagtggaagtaaaaacattagaaaaagtattaaatgaaaatatagatacatcagtagtttgtataaatttacagaaaatattagctcagtatgttagatttaaaaagaatcttccacatgttactccattctattctgtaaaaagtaataatgatgaagttgtaatcaaatttttatatggattgaattgtaattttgattgcgcttcgataggtgaaataagtaaagtaataaaattattaccaaatttatcaagagatagaataatttttgcgaatacaattaaaagtattaattctttaatatatgcaagaaaggaaaatattaatttatgtacttttgataatttagatgaattaaaaaaaatatataaatatcatccgaaatgttctttaatattacgtattaatgtagattttaaaaattacaaatcttatatgtcttcaaaatatggagctaatgaatatgaatgggaagaaatgttattgtatgcaaaaaaacataatctaaatattgtaggtgtatcatttcatgttggtagtaatacaaagaatttatttgatttctgtctagccattaaattatgtagagatgtattcgatatgagtagtaatatgggatttaatttttatataataaatttaggagggggatatccagaagaattagaatatgataatgcaaagaaacatgataaaattcattattgtactttaagtcttcaagaaattaaaaaagatatacaaaaatttcttaatgaagaaacatttctcaagacgaaatatggatactatagttttgaaaaaatatcattggctattaatatgtcaatcgatcattattttagtcatatgaaagataatctaagagttatttgtgaacctggtagatatatggtcgctgcttcgtcaacattagctgttaaaattataggaaagagacgtccaacttttcagggcattatgttaaaagatttaaaagaccattacgatcctttaaattttgctcaacaagaaaataagaaacaagacgaaacaaaaataaaccacaataatgataataatgataataatgataataatgataataatgataataatattaataataataataataatcaaaaagggggccaaggaaatattatgaatgatctaataataactagcacaaatgattctactaataaaaagaatgatcattcttctagtcaagttattcaaaatgtatcgtgcacaatacgtgataaagaaggagataatattaaaataaatacacataccataaataatcctaatataaatggaaaagaaaataccgtggatggtgataatattaatattgctcataaaaatattggtaataactttagtagtagtaattcaaaattaggcaacataacaaatattaagaaaaaagttgttaatattaatgacaatagatataattatttctcatattatgtaagcgatagtatatatggttgttttagtggtataatttttgatgaatacaatagatgtcctatttatgttattaaaaacaaaaataaccctaatcaaaattttatgaattttaatttgtatttagctaatgtatttggacaatcatgtgatggcttggatatgatcaattctattacgtacttacctgagtgttatattaatgattggcttctctatgaatatgctggggcatacacttttgtcagctcatcaaactttaatggatttaagaaatgcaagaaggtgtatatattccctgaatcgaaaccttcccttaaggggcaaccaaacaaacattggtaa

SEQ ID NO: 231 - DNA, 1068 bp, Plasmodium falciparum
atgaaagttggtaaaatattctttttgttaaacatccttgtagtatgccacttcattatatcatgcttatgtcgaaatggacaaactactcgtgggaatttattagcattaaaagccattgaacaggatttacaacaaaagaagaatagaaaaagaaatttgattttatattcactaggttctgcagcattaatagctgcccttgtcgttacaggtataggacttaatatgtatatgaaaaagaaaaatgttgactctgaggtacaagaaattatagatgaaaaagatgaaaaagttaaagaaaaaccagctgagaaaaaaaaaactacagtaaaaatagtttccaaaagagttcctgtaaaatctaaatcttcaaatggtaaatcaaaagcacgtaccgtaaattcggaggtatctccaaaattagatgatgaaaaaaaagaagatttattaaaatttaatgataatgatcttttattagcagctgaatcattaaaagaattgaatccaaaatatgatgaaaatactcaaggaaatgattcttttaaaaatattaatgaacctagaaaacttgcttcttttagtctttatgacgcattagctgatgcttctgaacaaaataaaaacaaagatgctgaaagttctacaggtcaaatacctactccaacagaaagtagtcatggtatatcagatggtaaaaaagatacatccacaaatgatatggatcctttaaatccttatggttcatctaaaagaaattcctctgaagataaaccaacatctgaatcaaaaggcacgacaccagaatctaattttgattccaaaactcctgaaataaaggaaataaatgaaccaattatagtaccttcatattatccaactactggtccaaatcctaatacccatggaccaccaagcagaagaatttcaacatctagatcttctggatcgtccaatagaagttcatcaggaactagtacaagatccaaaggtccttctagcccattacgcgattcttcaggaagatcaagtggaagaagtaccacaccaagagtcagaaaagaataa

SEQ ID NO: 232 - DNA, 657 bp, Plasmodium falciparum
gataatcagcttaggaaaaagtacaagcttcaatacaaacctctgtcggatgaagacccattattatgggttgacgctcctttaataaaaataaaagaattcgaaagaaaatttcctgaactagctttatggcctagaaatgtatcccaatcaaatgtagaagtgaacaacgctaatgatgcatttaataagcaatggtatttattagctaatcaattaatattaagtttaagtaaatatgaaggtggtcatatatttgagaaattagtagatgctaaaaaacagaattgtccagattattatgatgtaattaaaaacccaatgtcatttagttgtataaaaaccaaattaaagaagggtcagtatgcatatccttcagaatttgtaaaagatgttcaattaatttttgataactgtagtttatataatacttcaaattctgtagtcgcaattacgggcaaaaatatcgaaacttattttaataaccagttaatagtaatgggatataataacttcattttaaaagaaaaaaaaattaatgacatgttaaaacttgtagaagaagaaaatattaagtggagtaaagaaaaagaagatcaaatagaggaaatagacgaattagaaaataatcaagaggatagttcaaaaaaagattga

SEQ ID NO: 233 - DNA, 1758 bp, Plasmodium falciparum
atgaatagaatcttgtctgttacattatgtttgttttttatatatttatatatatataaaacatatggaaaagttaaaaatacagatgaaggattatcaaatatctatggagcaaaatattatttaagaagcggattatttaatgaaaaaaatggtaaaggacaaaaatatgaagatttagaagaagaaaaagaaggcgaaaatgacgacgaagaggattcaaatagtgaagaatccaataatgatgaagaaaatgaactaataaaaggtcaagaaggtgttgaacaagaaactcacggatcagaagatgaagtaagtaatggacgagaagataaagtaagtaatggaggagaagatgaagtaagtaatggaggagaagatgaagtaagtaatggacgagaagataaagtaagtaatggaggagaagatgaagtaagtaatggacgagaagataaagtaagtaatggaggagaagatgaagtaagtaatggacgagaagataaagtaagtaatggaggagaagatgaagtaagtaatggacgagaagataaagtaagtaatggaggagaagatgaagtaagtaatggacgagaagataaagtaagtaatggacgagaagataaagtaagtaatggaggagaagatgaagtaagtaatggacgagaagataaagtaagtaatggacgagaagataaagtaagtaatggaggagaagatgaagtaagtaatggacgagaagataaagtaagtaatggaggagaagatgaagtaagtaatggacgagaagataaagtaagtaatggaggagaagatgaagtaagtaatggacgagaagataaagtaagtaatggacgagaagatgaagtaagtaatggacgagaagataaagtaagtaatggaggagaagatgaagtaagtaatggacgagaagataaagtaagtaatggaggagaagatgaagtaagtaatggacgagaagataaagtaagtaatggacgagaagataaagtaagtaatggaggagaagatgaagtaagtaatggacgagaagataaagtaagtaatggaggagaagatgaagtaagtaatggacgagaagataaagtaagtaatggacgagaagataaagtaagtaatggacgagaagatgaagtaagtaatggacgagaagataaagtaagtaatggaggagaagatgaagtaagtaatggacgagaagataaagtaagtaatggacgagaagataaagtaagtaatggaggagaagatgaagtaagtaatggacgagaagataaagtaagtaatggaggagaagatgaagtaagtaatggacgagaagataaagtaagtaatggacgagaagataaagtaagtaatggacgagaagataaagtaagtaatggaggagaagatgaagtaagtaatggaggagaagatgaagtaagtaatggacgagaagataaagtaagtaatggaggagaagatgaagtaagtaatggacgagaagataaagtaagtaatggaggagaagatgaagtaagtaatggacgagaagataaagtaagtaatggaggagaagatgaagtaagtaatggacgagaagataaagtaagtaatggacgagaagatgaagtaagtaatggacgagaagataaaggaggagctggaacggatggagaactttcacataatagcgaaagtcatactaaaaacaaaaaatcaaagaatagtataattaatatgttaattggaatgtga

SEQ ID NO: 234 - DNA, 2094 bp, Plasmodium falciparum
atgaagaaaatatatagtattttcttttctttatttattttgaatcttcatatatatataaaaaatatcaaatgcaatgacctaataaattataatgattcgaatctaagaaacggattactaaataatagtttagatttaacaaatggattaaataacaaagataacagttttattgattctaaaattgaagaacatgaaaataaatcttaccaaaataaagataataatatctctatcgttggacaagatgtgcctattacatcggtatattcttctaaaattataaatgctaatgatttagaaggaaatagtattgacgatactaaaggtcttagtgttactaatagtggatttgatgatggtagtgcttttggtggtggactccctttttctggttattctcctctacaaggaaatcataataaatgtcctgatgaaaatttttgtaagggtattaaaaatgtcttatcctgtcctccaaaaaattctactggtagaaatggggattggattagtgtggctgttaaagaaagttcaactacaaataaaggtgttcttgttccccccagaagaacaaaattatgtctaagaaatattaacaaggtttggcatcgaatcaaagacgagaaaaattttaaagaagaatttgttaaagttgctttaggagaatcaaatgctttaatgaaacattataaagaaaaaaatctgaatgcccttacagctataaaatatggattttcagatatgggagatataataaagggaacagacctaattgactatcaaattactaaaaatataaatagggcattagataaaatattacgtaatgaaacaagtaatgacaaaattaaaaaacgtgtagactggtgggaagctaataaaagtgcattctgggatgcattcatgtgtggatataaagttcatatcggaaataaaccatgtccagaacatgataatatggacagaataccacaatatcttagatggtttagagaatggggaacatatgtttgcagcgaatataaaaataagtttgaggatgtaataaaattatgtaatatccaacaatttacaaaccaggatgattcacaactattagaaatatcaaaaaaggataaatgtaaagaagcattaaagcattatgaagaatgggttaatagaaggagacctgaatggaaaggccaatgtgataaatttgaaaaagaaaaaagtaaatatgaagatactaaaagtataactgctgaaaaatatttaaaagaaatatgttctgaatgtgattgtaaatataaagatttggataatacatttaaagaatttaaagataacgttacacttcttaaagcagtaattgataacaaaaaaaatcaagattctctaacaaccacttctttatcaacgtctattaatagtgttagggattctagtaatctagatcaacgagggaatataacaacatctcaaggaaattcacaccgtgcaactgttgtgcaacaagttgatcaaaccaacagattagataatgtaaactctgtaacgcaaagaggaaataataactacaacaataatttagagcgtggattgggttctggtgctcttcctggtacaaatattattactgaagaaaaatattctctagaattaataaaattaacatcaaaggatgaagaagatattataaagcataatgaggatgtgagagaagaaatagaagaacaacaagaagacatcgaggaagatgaagaagaattggaaaatgaaggagaagaaacaaaagaagaagatgatgaagaaaagaatgaaacaaatgatacggaagatacggacgatactgaagatacggaagatatagaagaggaaaataaggaaaaagaactcagtaatcaacaacaaagtgaaaaaaaaagtatttcaaaagttgacgaagattcatatcgaatactatcagtaagttataaggacaataatgaagtaaaaaatgttgctgaatctatagtgaaaaaactatttagtttatttaatgataataataatttggaaactatttttaagggtttgacagaagatatgacagatttatttcaaaaataa

SEQ ID NO: 235 - DNA, 1698 bp, Plasmodium falciparum
atgaaacatattttgtacatatcattttactttatccttgttaatttattgatatttcatataaatggaaagataataaagaattctgaaaaagatgaaatcataaaatctaacttgagaagtggttcttcaaattctaggaatcgaataaatgaggaaaagcacgagaagaaacacgttttatctcataattcatatgagaaaactaaaaataatgaaaataataaatttttcgataaggataaagagttaacgatgtctaatgtaaaaaatgtgtcacaaacaaatttcaaaagtcttttaagaaatcttggtgtttcagagaatatattccttaaagaaaataaattaaataaggaagggaaattaattgaacacataataaatgatgatgacgataaaaaaaaatatattaaagggcaagacgaaaacagacaagaagatctagaacaagagagacttgctaaagaaaagttacaggggcaacaaagcgatttagaacaagagagacttgctaaagaaaagttgcaagaacaacaaagcgatttagaacaagagagacttgctaaagaaaagttgcaagaacaacaaagcgatttagaacaagatagacttgctaaagaaaagttacaagagcaacaaagcgatttagaacaagagagacgtgctaaagaaaagttgcaagaacaacaaagcgatttagaacgaacgaaggcatctacagaaacgttgcatgagcagcaaagcgatctagaacaagagagactagctaaagaaaagttacagggacaacaaagcgatttagaacaagagagacttgctaaagaaaagttgcaagaacaacaaagcgatttagaacaagagagacttgctaaagaaaagttgcaagaacaacaaagcgatttagaacaagagagacgtgctaaagaaaagttgcaagaacaacaaagcgatttagaacaagatagacttgctaaagaaaagttgcaagaacaacaaagcgatttagaacaagagagacgtgctaaagaaaagttgcaagaacaacaaagcgatttagaacaagagagacttgctaaagaaaagttgcaagaacaacaaagcgatttagaacaagagagacgtgctaaagaaaagttgcaagaacaacaaagcgatttagaacaagagagacgtgctaaagaaaagttgcaagaacaacaaagcgatttagaacaagagagacttgctaaagaaaagttgcaagaacaacaaagcgatttagaacaagagagacgtgctaaagaaaagttgcaagaacaacaaagcgatttagaacaagagagacttgctaaagaaaagttgcaagaacaacaaagcgatttagaacaagagagacttgctaaagaaaagttgcaagaacaacaaagcgatttagaacaagagagacgtgctaaagaaaagttgcaagaacaacaaagcgatctagaacaagagagacgtgctaaagaaaagttgcaagaacaacaaagcgatttagaacaagagagacttgctaaagaaaagttacaagagcagcaaagcgatttagaacaagagagacttgctaaagaaaagttgcaagaacaacaaagcgatttagaacaagagagacgtgctaaagaaaagttgcaagaacaacaaagcgatttagaacaagagagacttgctaaagaaaaa

SEQ ID NO: 236 - DNA, 1578 bp, Plasmodium falciparum
aaagacttgctgagacttgctaaagaaaagttgcaagaacaacaaagcgatctagaacaagagagacgtgctaaagaaaagttgcaagaacaacaaagcgatttagaacaagagagacgtgctaaagaaaagttgcaagaacaacaaagcgatttagaacaagagagacttgctaaagaaaagttgcaagaacaacaaagcgatttagaacaagagagacgtgctaaagaaaagttgcaagaacaacaaagcgatttagaacaagagagacgtgctaaagaaaagttgcaagaacaacaaagcgatttagaacaagagagacttgctaaagaaaagttacaagagcagcaaagcgatttagaacaagagagacgtgctaaagaaaagttgcaagaacaacaaagcgatttagaacaagagagacttgctaaagaaaagttacaagagcagcaaagcgatttagaacaagagagacttgctaaagaaaagttgcaagaacaacaaagcgatttagaacaagagagacttgctaaagaaaagttacaagagcagcaaagcgatttagaacaagagagactagctaaagaaaagttacaggggcaacaaagcgatctagaacaagagagactagctaaagaaaagttgcaagaacaacaaagcgatttagaacaagatagacttgctaaagaaaagttacaagagcaacaaagcgatttagaacaagagagacttgctaaagaaaagttgaaagaacaacaaagcgatttagaacaagagagacgtgctaaagaaaagttgcaagaacaacaaagcgatttagaacaagagagacgtgctaaagaaaagttgcaagaacaacaaagcgatttagaacaagagagacgtgctaaagaaaagttgcaagaacaacaaagcgatttagaacaagagagacgtgctaaagaaaagttgcaagaacaacaaagcgatttagaacaagagagactagctaaggaaaagttgcaagaacaacaaagcgatttagaacaagagagacgtgctaaagaaaagttgcaagaacaacaaagcgatttagaacaagagagacttgctaaagaaaagttgcaagaacaacaaagcgatttagaacaagagagacgtgctaaagaaaagttgcaagaacaacaaagcgatttagaacaagagagacgtgctaaagaaaagttgcaagaacaacaaagcgatttagaacaagatagacttgctaaagaaaagttacaagagcaacaaagcgatttagaacaagagagacgtgctaaagaaaagttgcaagaacaacaaagcgatttagaacgaacgaaggcatctacagaaacgttgcatgagcagcaaagcgatctagaacaagagagacttgctaaagaaaagttacaagagcagcaaagcgatttagaacaagagagacttgctaaagaaaagttacaagagcaacaaagcgatttagaacgaacgaaggcatctacagaaacgttgcgtgagcagcaaagcgatctagaacaagagaaactagctaaagaaaagttacaggggcaacaaagc

SEQ ID NO: 237 - DNA, 1572 bp, Plasmodium falciparum
agcgatctagaacaagagaaactagctaaagaaaagttacaggggcaacaaagcgatctagaacaagagagactagctaaagaaaagttacaggggcaacaaagcgatctagaacaagagagactagctaaagaaaagttacaggggcaacaaagcgatctagaacaagagagactagctaaagaaaagttacaggggcaacaaagcgatttagaacaagagagacttgctaaagaaaagttgcaagagcgacaaagcgatttagaacaagagagacttgctaaagaaaagttgcaagaacaacaaagcgatttagaacaagagagactagctaaagaaaagttgcaagaacaacaaagcgatttagaacaagacagacttgctaaagaaaagttgcaagaacaacaaagcgatttagaacaagagagactagctaaggaaaagttacaggggcagcatagcgatttagaacgaacgaaggcatctaaagaaacgttgcaagaacaacaaagcgatttagaacaagagagacttgctaaagaaaagttgcaagaacaacaaagcgatttagaacaagagagacgtgctaaagaaaagttgcaagaacaacaaagcgatttagaacaagagagacgtgctaaagaaaagttgcaagaacaacaaagcgatttagaacaagagagacgtgctaaagaaaagttgcaagagcagcaaagagatttagaacaaaggaaggctgatacgaaaaaaaatttagaaagaaaaaaggaacatggagatgtattagcagaggatttatatggtcgtttagaaataccagctatagaacttccatcagaaaatgaacgtggatattatataccacatcaatcttctttacctcaggacaacagagggaatagtagagattcgaaggaaatatctataatagaaaatacaaatagagaatctattacaacaaatgttgaaggacgaagggatatacataaaggacatcttgaagaaaagaaagatggttcaataaaaccagaacaaaaagaagataaatctgctgacatacaaaatcatacattagagacagtaaatatttctgatgttaatgattttcaaataagtaagtatgaggatgaaataagtgctgaatatgacgattcattaatagatgaagaagaagatgatgaagacttagacgaatttaagcctattgtgcaatatgacaatttccaagatgaagaaaacataggaatttataaagaactagaagatttgatagagaaaaatgaaaatttagatgatttagatgaaggaatagaaaaatcatcagaagaattatctgaagaaaaaataaaaaaaggaaagaaatatgaaaaaacaaaggataataattttaaaccaaatgataaaagtttgtatgatgagcatattaaaaaatataaaaatgataagcaggttaataaggaaaaggaaaaattcataaaatcattgtttcatatatttgacggagacaatgaaattttacagatcgtggatgagttatctgaagatataactaaatattttatgaaactataa

SEQ ID NO: 238 - DNA, 2445 bp, Plasmodium falciparum
acagcattaaatacatctgtcgatatgaaaaaaggaaaaaataagttgaacaataatatgaagggtttaagtagtcctgtatcaaatgtagaacaatttgttatagatgatatgatgaaaacagaagaacaagaaggaaaggagaaaaatgatataccaatatatatgccgaatttatctcttttaggtaatatgaataaaaaaatattttttggtaatatcaatataagtggtgataatattgaaaatttcaatatgtctgaaaacagtgttatggaacatatgaaacataataatatgttaaatgaggttgataataataaaatattaaatgctgaaaataaaaagaaaataaataatataagaaaaaattatgccttagaagcatcatcaatgggattaagtaataatgataataatatatcatcacaatattataaagaagaaaataataacaatatgaacaatcgtaattatgacgtaaaccattctgatttaagaaaccaaaaggatagagaatttaaacattttgattttaaaaataaaaaccaaaaaagagaagattatcacaacaataacaatataaatagtattcataataatgatttattcaatgaaagcaaaaataaatctacttatgtatcatccaataaaaattcacatcatataaataacaataataataataataataataaatcaaataatttgacattacccaagatcggggcatcatcagcatcgaattcattaagtcatcaacaattacaaacatcaattaataatacaaaacatttgttaaatacctctacaaatacagcttttcttaataaatcatcaactgttgcaacacatggatcccaagaaaattcttctgcagcttttatgagtggtaaaaacagtaaatatcttcaaggctcttttaaaaataagaattatgataataatgatttggatgacactaattcaatacaattaaatcaaatatcccagaaatttttacgaagtcatcaaaatgtagtaaataataatatatcaacaagtggtattaataataatacaactagtgctacagttattagtacaaataataataataatacgagtagtgcaaccaataataataataataataataacacatcaaacgtaaatattacgaataaaaataccagcagtgatattaataatattaacttaatgaatatgggtatgaataatttgaataataataacatgtatagtacatataattctcctccaggtttagcgaatcagtataattattcttatggaaacttgtcatatccatacaacaacatgccctataatggttatacaactcaagcattggttccacaatatggattaatgaataatcattataataaaagtagtagtatacataacaacaatttcaattataatataaattatgagaatttcgatgaatctaatttatatgcacataataataacatccacatgaataatagttttgtgaattttataaatggaaataacgttaagaaaaatcaactcaatggagatgatgataatattagtaactctggagacatgacaataacaggaacacatcaagctataaatttgactcatgataattcaacaaataatgttaatcaaaatgcaaccaatgtaaataacaataatagcagcaataataataacaataataataataacaataacaataacaataacaacaacaataataataataataataatggtgtgtgtgtagataatactaccaatagtggacttggtaatttatctctgaacaacattaataataacctaaacactaatataagtatttcatgtaacacaacagatttaaaaaataagcaacaattaaataaaaatataaatgatttacaattacaaacatcaacacaaagcttaaaacaaaacttacatacacacaataaaaataattcaatgagtacaaaccaacaaactattcaaaataaacatacagggcaacatcaacagaatttattgaataataataattcattaggacaatatacgcaaaaccaaatacagccaaatacatctcaaaatactgcatcttcaacatcttcatctgttacgggaaaggcagatacaaataatataaataatgcttcacagaataatcaaaataattatataagcaaacaattatatcataatagcaattattataatataaattcaagtagttttaatataccaccaggatttaatatgtctcaagataaagaacaaaataataattacttaaataataatattacaactaataataataatacaaatgtaagtgcatacagaaataattggaatagtattaatgaaaaaaatttaaatcactataatttaaattataattataataggagtaacaaaaacagttttaattacaccagcaacttc

SEQ ID NO: 239 - DNA, 774 bp, Plasmodium falciparum
ttaaaagatagcacaaatggagaatttacaaaaaaggtaaaaaaacaattaaaagattattatgaaatgcgatttgataaaaaggtaataaacttaccatttagcacagattcgataaatatacaacaaagaggttttcatgattatagtaaagatatgaaattaaaaaagaatcatatgaataagcccttgtggatatgttcagatggatttatatatttagaaatgtttaatagttgtagtaagcaagcatctgattttttaataacaatagctgaaccaatatgtagaccagaattaattcatgaatttcaattaacgattttctctttatatgctgcaatatcagttggtataacacttgatgaattattaattaatttagataaattttctaaaaatgttttacccaatgaattaatatctaatatcacaaaaagtgctgaatcgtttggaaaagtaaaattagtgttaagggaaaataagtattatatagaagcaacaaacaaatcagagttagattatttattaaataatgatacaatacaaaatgcaagaatatattctactgataataataatgataaaaatatgataagtttgtataatttgaataataggcatagagataataacaaaaatgataataaaaataataacgatgataataataatatagacaaaactacaagtaatttattaaatgaagaccaaaaaggaaaagattgctacgtaacgtatgaggccccagtgttggatacaacacagttagga

SEQ ID NO: 240 - DNA, 234 bp, Plasmodium falciparum
gttgtaccagaagttgttgaagaggttgtaccagaagttgttgaagaggttgtaccagaagttgttgaagaggttgtaccagaagttgttgaagaggttgtaccagaagttgttgaagaggttgtaccagaagttgttgaagaggttgtaccagaagttgttgaagaggttgtaccagaagttgttgaagaggttgtaccagaagttgttgaagaggttgtaccagaagaacta

SEQ ID NO: 241 - DNA, 2343 bp, Plasmodium falciparum
cctgaagaactagtagaagaaattatacctgaagaaattgttgaagaggttatacctgaggaattgattgaagaggttgtaccagaggtattagttgaagaggtgatacctgaagaactagtagaagaagttatacctgaagaactatttgaagaggttgtaccagaagaattggttgcagaggttatacctgaagaaattgttgaagaggttatacctgaggaattgattgaagagtttgtaccagaggaattagttgaagaagaagtacctgaagaactagtagaagaagttatacctgaagtattagttgaagaggttatacctgaagaatttgttgaagaggtgatacctgaagaaattgttgaagaagttatacctgaagaaattgttgaagaggttatacctgaagaagttgttgaagaggtggtaccagaaattgttgcagaggttatacctgaagaagttgttgaagaggtggtaccagaaattgttgcagaggttatacctgaagaagttgttgaagaggttgtaccagaggttgttgaagaggttgtaccagaggttgttgaagaggttgtaccagaggttgtaccagaggttgtaccagaggttgttgaagaggttgtaccagaggttgttgaagaggttgtaccagaggttgttgaagaagttgtaccagtagaagtattagaagaagttatacctgaagaagttgttgaagaagtaataccagaagaatttattgaagaaatgatacctgaggaaatagttgaagaagtggtacctgaagttgttgaagacgtaatacctgaagaattgattgcagaggttgtaccagaggaattagttgaagaagaagtacctgaagaactagtagaagaagaagtacctgaagaactagtagaagaagttatacctgaagtattagttgaagaggttatacctgaagaatttgttgaagaggtgatacctgaagaaattgttgaagaagttatacctgaagaaattgttgaagaggttatacctgaagaagttgttgaagaggtggtaccagaaattgttgaagaggtgatacctgaagaactagtagaagaagttatacctgaagaaattattgaagaggttatacctgaggaattgattgaagagtttgtaccagaggaattagttgaagaagaagtacctgaagaactagtagaagaagttatacctgaagtattagttgaagaggttatacctgaagaatttgttgaagaggtgatacctgaagaaattgttgaagaagttatacctgaagaaattgttgaagaggttatacctgaagaagttgttgaagaggtggtaccagaaattgttgaagaggtgatacctgaagaactagtagaagaagttatacctgaagaaattgttgaagaggttatacctgaagaagttgttgaagaggttatacctgaagaagttgttgaagaggtggtaccagaaattgttgaagaggtggtaccagaaattgttgaagaggttgcaccagaagttgttgaagaggtgataccagaagttgttgaagaggtgatacctgaagaactggtagaaaaacttataccagaagaactagtagaagaagttatacctgaagaactagttgaagaggttgtaccagaagaagtagtagaagaacttataccagaagaactagtagaagaagttataccagaagaacttgtagaagaagttatacctgaagaattagttgaagaggttgtaccagaggaattagttgaagaggtggtaccagaagaactagtagaagaagttatacctgaagaactagtagaagaagttatacctgaggtattagttgaggaagaagtacctgaagaactagtagaagaagttataccagaggaaattgttgaagaggttatacctgaggaattgattgaagagtttgtaccagaggaattagttgaagaagaagtacctgaagaactagtagaagaagttatacctgaagtattagttgaagaggttatacctgaagaatttgttgaagaggtgatacctgaagaaattgttgaagaagttatacctgaagaaattgttgaagaggttatacctgaagaagttgttgaagaggttgtaccagaaattgttgcagaggttatacctgaagaagttgttgaagaggttgtaccagaaattgttgcagaggttatacctgaagaagttgttgaagaggttgtaccagaggttgttgaagaggttgtaccagaggttgttgaagaggttgtaccagaggaattagttgaagaggtgatacgaggtggtaccagaagaactaag

SEQ ID NO: 242 - DNA, 834 bp, Plasmodium falciparum
gcacataataaaaataaatcatacatagcaccgcatataccaactactacaacacgagtgttaagcgaatgtaacgtatatattcccaattatgataatgatccggatatgaattctgtgagggaaaatttccataagaaaacagaacaaagatttcatgaatacgacaaacgtatgatcaaaaacagacagaaacgtaaagaagaacgtgacaaaaatatacaagaaattattgaaaaagatagaatggacaaatcattagcagaaaaagtggaaaaaggttgtcttaagtgtgggtgtgggttaggaggtgttgcagcaagtattggaatatttggaacaattgctgtaaatgagtggacaaaagctgctacggctgcggcaattgatttggctattcaggagggtattgatgctggtgtaaaggtagtaattgcagaaataaaagcaactaatgcttttaaaagtatatggtatgtagaattgtcaagtttcattaatggatcaaattataatactgtcgatggtctttctgcagcaactaaggctgccttggattcaattggaaaacggtgcacatctagtattgtggatagagcgtgcaacggaatattaaacaatagtgatgggtggtttagttcaattgcggaagccggtaaacaagctgctactgccgcaactgaaagtgctaaaacaactaaacttgttgatgtaacaactacaagtacacatttgtacagtgcaattggttattcagttcttgccatatttattatattattggttatggtaattatttatttaattttacgttatcgaagaaaaaaaaaatga

SEQ ID NO: 243 - DNA, 2610 bp, Plasmodium falciparum
atggggtcacaaacatcaaaattttctaaaactgttgttggaaatgaaacacacaacagtgcccgaaatgttttggaaggttttgcaaaagatataaaaagggatgtatcaaataacgcaaaaagacatggaaaagttttgaagggaaatttgagagatgccaaattttatcatgattattctaagttaagagacatacctagaagtccctgtgatcttgatttttggtttcatacgaatgtttggagggacaaagcatatgaaagagatccttgttatggcagacaagcaaaaaataattacaatttggaaggagcagtatgtacgaatagtaaaataaaaggtaatgaaaacaagataaatgacattggagcgtgtgccccatatagaagacgaaatatatgcgattataatttagaacatctaaatgaaagaaatgttttaaatactcatgatttattgggaaatgtgttagttatggcaaaacgtgaaggtgaatctattgttgagaaacatccaaatagaggatcttcagaagtatgtattgcccttgcaagaagttttgcagatataggagatattttaagaggaaaagacatgtatgtcgggtatgatgaaaaagaaaaaaatcgaagaaaacaattagaaaataagttgaaagatattttcgataatatatataaggatttgacgaagaagaaggggaggaatgggaagaagtcggcgctacaagaacgctacaatgatcctaaaggagatttttttcaattacgagaagattggtgggcgcttaatagagaagacgtatggaaagcattaacatgttctgcggatgacagtgaagattatttcatacaatcagaaggtgttacaaaatcatttacaaatcctaaatgtggccatggtgacaatgaggttcttacaaatcttgattatgtccctcaatttttacgttggttcaccgaatgggcagaagagttttgtaggataagaaaaattaaattaggaaaggttaaaaacgaatgtcgtggtgagacatcaggtaaaaggtattgtagtggcgatggttatgattgtactaaaacagatatatcacgtaatattttttatatggatttagattgcccacgttgtgaagaagaatgtagaaaatatgatgaatggattgaaaataaagaaaatgaattagataaacaaaaaaataaatacactaaagaaattgaaaaattaaaagataattctaagagcaattatgataaaaatttttatttaacacttactaaaaaatatggttcaattaacttatttttagatacattaaaagaaggatcacattgtagctacaataccatagaagataaaatagattttaacaaagcaaatcaaacatttactagttcgaaattttgtggggcatgtcctttttatggagttaaatgcaattggaaaacatgtacagaggttaaggaaaatgagtacaaaaaaaaaaataaggttgatagtacacatacgacagaacaacctactgctattgatgtactagttactcatattagaggaacaaatattcccgaagatttaaaggattgtaaaaaatatggtctttttaaaggtatgcgaaaacaagcgtggaaatgtcaatatataaatccatatgatgaatgcaagttgagtccttttgtgaaagatatagatgttgatgatcgtattttatttaaagtattgtttgagcgttggttaaaatatttcatacaagattttaataatgttaaggacaaaattaatagatgtacaaaattcgaaaagggaaaagataatacatgtattaaaggttgtaaacataaatgcgaatgtgtggaaaaatggataaaaataaaggaagcagaatggaaaaaaataaatcaacattataaccaacaaaaaaaacattatacctatagtgttcctcgttgggttaatagttatttgacgcaccagcacttctctagtgattttattaatgcattagaagcttttaaaaatatacggggattagaaaatttgaaggaatgtagtagtgacacttgtaaaattgaaaaaattagaactatagatgatgatttaataaaagaattaatttctaaacttaaagataaatgtgctatgtgtaaaaaccaacataaagcaaccaaaggtaaagaatgttgtggtaaattacctaaaactctaaatgatcaagatgatgaagaagacgaagaatacgaagcaccaccaccaccaacacctcctcgcacccaaaaaaacccctgcgttaatggtcaaaaccagaaggttcgtaaaatcaggagcgtgagacgagtgccgaaaaggatgcaaaaacaagcaagtgttcgtgttcctcgtgctcggcagggaggggagagggagcaggttgtaaagaacgggcgccaggaccaccacctccagcgggtgcttttggtgggggaggcggaggcggaggagccggagacggcggaggaaaagaaggaggaggaaaaggaggaagacacggacgggaaggtacagccaccaccagcagcaacaacacccggggtgaagccgccatgtgacatagttgaaaaacactttaaa

SEQ ID NO: 244 - DNA, 2604 bp, Plasmodium falciparum
tcatgtggttatttctgtggtttagatatatgtacacccaacaaaactacaggtgatatacatgataaacaaaatgcaccaattagagtactgtttaaacgatggatagaaaattttttaaaagatcataacaaaattaaagacaaaatttctttatgtataaataatgaaaacagaaatatatgtacagatgtttgcagaaaaaattgtgaatgtatagataaatggatagagatgaaaatgaaagaatggaaaatagtacgcgatcgttacgtcaaacaatataatgttgctgattcagtagtttacgaagtgagaagatttttagagggcttgcaacctcaaaatgaccttgaaaaagttaaaggagatgttaatgatttacgtgatttagaggaactaagtgaatgtactaatactgtatcaacagaaaatagaaaatgtagaaaaaaggatgtagtagaaagtttgcttaataaacttaaaaatgaaatacgtcattgtaaaaatgaacgtgacgatagtatgggcaaggaaagttgcaaaacattacccgaacctacagacgatccacaaacagatagtgatacccacgacacacctgacataccaccaggtgacgttgcacccactttttgtaatgttccagcaaatccatgtggcgacaaaagcgccaccaatgtggtaaatgtgacagaggtggcgaaggaaatgcacgaagaggcacacaaggatatgttagagaggagtgttaaaaaggttgagagtaaggttaaggatagtacggttgagagtgtgttaagggctgatgcatcaaaaggtgaatataaacatgaaggtaatccagatgacttgaaacacaacatgtgcaatataacgaaggaacataccaattatcaaaaacgtggtggttataattatcgaggaccatgtacgggtaaaggtaatggtaaagacacaagatttgtcataggaaccatatggaaagatgaagacgaaaaagatgaaaccattaaagttctgttgcctccgcgacgtcgtcatatgtgtacatcaaatttagaatatttacttcatgttaataagggcccacttctaaaagttgaacctgataaaattaatcattcctttttgggggatgttttgcttgcagcaaaatatgaagcagaattcataaaaaccaattatacgagattaaatggccaaaatgacaatggagctaaatgtagagctatgaaatatagttttgctgatataggtgatattatacgaggaaaagatctgtggggaattcaggacttcaaggatctacaaactaagttagtaacaatatttggtaaaattaaagaggaaattcccgatattaaaaaaaaatatagtagtgaaaatcccccatatacgacattacgtgaacattggtgggaagcaaatcgagccaaagtatgggaagcaatgcaatgtccaacaataccaccagtcaccacaagttgtgatactaccactgttacccctcttgtggattacatcccacaaagattacgttggatgaccgaatgggccgaatggttctgcaaaatgcagtcacaggagtatgaggtgttagtgaaacagtgtaggaattgtaggagtggaatatgtgagaatggtaaggatgactgtgtcaagtgcacacaagcttgtaatacatataaacaaaaaataaaaaaatgggaagatcaatggaaggaaatatcaaaaaaatacaaaacattataccaacaagcaaaaggcagtgttaatggtgctactactagtagtactacagatgagaaagacaaagatgtcgttgatttcttgaaaatgttacaccaaaaaaatactgataataccatatatactactgctgcaggatttatacatcaagaagcacatatgactgattgtcaaaaacaaacaattttttgtaaaaacactagttataacgacaagaagaaatatgcttttcgtcatccaccacatgatcatgatgatgcgtgtgcttgcaggccaccatcaacgccagtagacgtctcccgcaaactagacacccaacgtgaccccaaaaaagaggaatctgaacctgaatccgaagaagaagaagacgatgccgaagaggaggaggagccggcaaaggagacggctaccacagagacaacacaaccagcagcaccagcgggaccaccggtaacaccagtaccagaactaccgggaccacccgcaccagcgggaccagcagctgatggccccattgaggatgacgaagacgccgaaaacgaagacgatgatgacgtcggctccgccaccggcacagaagacgatgacgacgacgaagatgacgacgacgaagacgaagaggactcagcagacgaaggtgaaggtgaaggcgacggcggtgacgtcggcgaggaggaagatgaagatcacggcggccaggaggcggagggggtggtaccacaaccagcagcaccacaaccaccaaccccacaactcttggatgaccccctccttaaaaccgccctcatgtcttctaccatcctctggatggtaggtatcggttttgcggcgttgacttactttttactcaag

SEQ ID NO: 245 - DNA, 1269 bp, Plasmodium falciparum
aaaaaatccaaatcttctgttgacttgttgcgtgtactgaatatcccgaaaggagattatgaaatgcctacgttgaaatccaaaaataggtacataccatatagaagtggttcatataaaggcaaaacatatatatatatggaaggagatagtgatagtggacactactacgaagatacaactgatattacttcatccgaaagtgaatatgaagaattggatattaatgagatatatccgtatcagtcaccaaaatacaaaacattgattgaagtggtactagaaccatccaaaagtaatggtaacacaccaagtaagggtgatggtaacacactaggtgatgatatggtacctaccacgaatacatttacagatgaggaatggagtgaattgaaacatgattttatatcacaatatatacaaagtgaaccactggatgtaccaaaagttggtgtatcaaaggaattaccaatgaatataggaggtaatgttttagatgatggtataaacgaaaaaccttttattacttctattcatgatagggatttatatactggggaagaaattaaatataatattaatatgggtactaatagtatggacgatccaacatatgtatcaaataatgtatattctggtatcgatttaattaatgacacattaagtggtaatcaacatattgatatatatgatgaagtgctaaaaagaaaagaaaatgaattatttggaacaaattataagaaaaatacatcaaataacaatgtagctaaattaacaaatagtgatcctattatgaaccaattagatttgttacatacatggttagatagacatagagatatgtgtgagaagtggaataaaaaggaagaattgttagataaattaaatgaacaatggaataaagataatgatggtggtgatataccaaatgataacaaaaagttgaatacggatgtttctatacaaatagatatagatgaaaataaaggaaagaaagaatttagtaatatggatacaaacgtggatacacctactatggatagtatattggatgatttggaaacatataatgaacctttttatgatatatttgaggatgatgtgtattatgatgtatatgatgaaaacccatttgtggatgatatacctatggatcataataaagtagatgtacctaagaaagtacatattgaaatgaaaatccttaataatacatccaatggatcgttggaacaacaatttcctatatcggatgtatggaatatataa

SEQ ID NO: 246 - DNA, 1713 bp, Plasmodium falciparum
aatgtacctagtattgaagaaaatacatattcaagagatatattagagaagagattttttagaaatttgtatgaagatgagttaataagaaaggattcaagcaaagttaacactagagaacatggaggtgaatcaaaggtattgcatttgagcgatataatatctgaagttctaaaggattctggtatgagtagaagcaatgttagaagtactaataaggttgatgttatttttgataagaaaggtgtgaaacctaatgtatatgaaaatatagaagtggaagaagatcctaatgaaaaagtaatatattctgttgagatatgtagtaagcaagttagtgattctaatagtgctgatagtaaaatgaaatatggagaacaactaaataatgattttatggggaatataaatgaacaagagtatattactgggaaattaggagtaagaagaggattaaaaatttatgatcgtaaaaaagaaatagaaaaactaaaaaatgaattaaaatttttaaataaactcaagtatgaaaactttgaagagtatgcaaaatataaaccaaaaagaaagccaagtgaaataaatagcgatatagctgaaagaaaagaagaaagagaggctgataatgcaaaactatcaatctttgaaaaagaaaaattagatatcgaagaaactaaaaaggatgagaaagtagcattagaaaaaagcactgacaatattagtaatattaaatcaaaagtggtaggaataaaagaaattgacgaagaaggaatggaaagcatatcaaaaacgattgataatagtaaaacatcagaagttgttgaagaaaaaaaaacagaagatgttgattcattaaacgaatgtttatatttttatccaaatgatggtgatagtatgaatttagaaaatgtgttaaaacatattatggaatatgataattctgaaaacacaatagatgatctaagtgaagaggaaaattataatcaattatttaatttattatatagggctttccagaataagttttataatatatttaaattacatgaaatgttatatcgtgatttgagcaatgtttctatatgggatgaatatgaattagatttatataatgtaaaagaaaatggtttgtatactgatgataaggatttggaactaaatgaaaacatattgtctttaaattctaaaaaaaatgatgtgaataccttaagggatatgtggaatcaaataaatagaaatgaagagaagaaaatttcagttacaatataccgtttaaattcactttatacgaatttaaaaaataaatatgatgtacctgttttccattcaactaatgaattgaataatgcttatggaaaatttttgattcatatgaattatataaaatcatattttaatggaatttttaatgaatggattaaaactagtgaagggaatatcaaagaatatagaattcttataatcgcatgtagattaatatggagaaaattaaagaaaaatactttacaatcacttgaacacattataaccaaaacttttgaaaagaaaattaaagagcatgaatcgtataaaaagtatcttgctcgtttgtataaagcaaaatatcaacaagaaaaacataattactcttggatgaaatttcttgatgaatataaaggagatggaagcagttcttatgaaaatagtattacagaagctccttatataggttaa

SEQ ID NO: 247 - DNA, 990 bp, Plasmodium falciparum
atgaaaacaaatatcttctcatgcgtgatatccttttttattttgttgcttttttgtaaagcttacaatacttcgtccttactagaaaccataaaacatgatcttcaaattgtaaataattccaactttaatacagtagtaaataagtttaggaatgaaaaagtgtttgcagttttattttttaaaaagtctaacaagaatataaaaaatgtaataaaaaattataatgatgtagcatcgaaatttaaaggaatattaacattatgtgttgtcgattgtgatgaaaatgcatccttatgtgaaaatgaattatcattatatgtaccagattataagagcagtaatacacatcacttcttaatctatcctataaatccaatgccaaaatttgtatttaaggatgaaataacagaaagtaatattaaaaaatatacatatttaattccttcaaaaattgatattattaaagatacacaatcttttaatgtattcttatcaaaacatgaaaatatgccaaaagtacttatatttagtaataaaaaaaaacccaactatgtacttaatgcattaagtaatagttttaataaaaaattaatgttcgcatatatcaataatgaaaatgaagaattagttgctaaatataacgtaaaaaacctaccaaccatattattactcaaaaaaaataaagttgtcgatacatataaaggaaaacaaaattatattaacatatttgattggcttaatgtatactctgaaacttttgtcctaggaggtggtttcgatatatctccagataaaactaatgaaaaaccatggaaatttgaactaattccaaaatttacaaaattgtcccatggagatatatgttttaaaaaagctgacaagggattgtgtttaatctatttgaaagaaggagaaaagttagaaaaaagtgaaatagacatgttactctccttaaaggaaaaattcaaaccacacatagacggacgg

SEQ ID NO: 248 - DNA, 207 bp, Plasmodium falciparum
atgatccttaatatatatatatatatatatatacacctatttatgttaatttatattataggtggtgcagcagcagttgttgctttaacatatatgttaatgaaagacgaagataatcatgatgataatgatgatgaaaatgataaaaaaaaaaaaaaagacaataaactatccaaagactcaaatagaattataaaaggagattcg

SEQ ID NO: 249 - DNA, 207 bp, Plasmodium falciparum
gttcatgctcttgagaacagagctattatggcctggtgtggagcacaaattttttcccaggctgaattgagagaatcacaaacaggaatatggatatcaaaagaagagtatgaagaaataggatccaacatttttttaacaaaggcaaggaaaaaaaaaaaaaaaaaaaaaaaaaaaaaaaaaagaattgatattagtgtgcattag

SEQ ID NO: 250 - DNA, 690 bp, Plasmodium falciparum
atgtccaaagataagagaaactcgtttgcatccaattcttttgattctagcaacgacgaaaaaaaatctaagaatggaaataaaatttataaatcaaaacatgaagagaatagtcctgatggtgattcatataaaataaataataacgaaaaagagaaaagtaaagaaaaattaaaaaaagatcaaaagaaaaaatctaaagaaatttataattcatttaattctcctaattctactagtagcgattcggatggaaatggattacatctaaatttttccaacgcatcaagtaatatttttaatatatatgctatatgtaaatatccgtattatatatgtagcatgtatatcttttttaaaaaaaagataataaatatatatatatatatatatatatatttggtttattatgtaggttcgagtagtgaaaacggatttaagatactacgaacacaagaaaatgaggataaacttctagaagaaagaagaagaaaaagagaagcattaaaagaaaaattaaaaaacatggttaaggaaaatgaacaaaataatgatgcgaatgaaatactacagaatgatcagataaataaagattataacaatgaaacttttttgttaagtgaaaataaaaatgataatgatataataacaaatgaaataccatctaatccatcatatatcgaccaaaat

SEQ ID NO: 251 - DNA, 2520 bp, Plasmodium falciparum
tatcattccaataataaaattaacgtaaataatttaaatataaatgatacatgtgtacaattatcactatgtaaacatcctaaacatagtacattcttctcatctattaattataaatcctattataaaaataaaaccaagtgtagtatacaagataccaattattataatgctcattattcaccccctttatttaataaaaatggacatatatttattttttgcgacgattattacgtaaaccatgaaaaatataataaaaatgaaaataaaaaatattcctatttatatcctaatgatgatataaaaaaaaagatgatatttaataaagaatctttttttttacctatacgtgaagggaacacttataatcaggaaagagataaagtaacaaatccttatctgaaacaaaaacaaaaaatagatacatatatgataaaagatgaatgtatagaaaaacaagaagaagatcaaaaaaaaaaaaaaaaaaacatttccttatcatgtatattaaaaaaaaatatattatattctgtagttgctaagggagacggattaaaaggtggaaaggtaaatgaatggatatctctttatgttcatacaataaataaagagggagataatatatattatggtaaacatataaatataagaatgaaaatcgaacctattggatatttaaaatcatattattcgttcagttattccaatataagcaaagaaataaaagataataataataataatattatgttaacacaatctaatgatgcaaatataatcaaaaatgaatataataatctatcattaatgtcctcccccatgtgttttcattcttttaatgatattcaagaaatgattaattataaagtagaagatttacagaatggtatatatcaaattttatataaagttaataaaattggaaagaaaaaattatatatatactgtgatggaataagtcttagcagttcgccttttgaaataaatatttgcccatcttcaccttgttctaaactatcaaaggttgtaggaaaaggagtaaccagatgtatatcaataccttatttatatgatataaataaggaatctttttttattaaccacttggaaaaaatagatcggaaatgtaatgggaagaatgatgatttggataatatgaaaaaaatgtataatttgaatgatatgaaaggaacgcataatgtggatgatatgaaaggaatgaataatgctgatgatatgaaaggaatgaataatgttgatgatatgaaaggaaagaataacgctgatgatatgaaagaaatgaataatgttgatgatatgaaagaaatgaataatgttgatgatatgaaagaaatgaataattctgatgatatgaaagaaatgaataatgttgatgatatgaaagaaatgaataatgttgatgatatgaaagaaatgaataattcgaatgacaaggagatatcaaataatatgtgcgacaaaaaggatagttccagtaatggtggtaattcacatattatatctattcaaaaaaatgaagactgtctaaaaataaacaacacaaataataataataataataataataataatgataatgataataatgtagacatatgttttggttataactctgtttgtgatacgtcggatagtaataaaaaaaatacaaatgtgaaatacttatatggtgaggaaaataactacatttttaaaagccctaaatattataacgaaattaatggaaatattataaaattaaatgaaaagaatgaaagaacgtttgaggagtttttaaaaaatatggtacaagtagtaaatacatttgacattattttatatgataaaaatggtgaaaggatatgtataggtaatgataatattaaagttataggaaaacgaggtgcttatataaaaaatgtaatagataataataatggtacttataccgtacaatattgttgttgtgtaaaaaaagatgatataaaaaagataagaaatataaataaagaaaaattaatagatttttatgatgaatttttatttcataaaaataaatattatgataatgttattattaatgaatttaagaaaagattttttaatatatttattaattgtgaagtaaaagtatatataaatgaagaagaaatttatggttctccattttttccaattataataaatatgcacgagattttaaatatatataatttatatgatcaatatacctactcaggaatgttattaaaaaattttgaatatttgttgacttttaataattatgaaggatgtatagagaacttatgtgagttttatgaaacatttgttgatacacaggatgatttaatagataataaaagtggaaagagcaaaacagaaaggttcctatctttatttcaaatgaaaaatgaggagaaaataaatatggataaaaagaattacacaagtttgttttttaatatacctttaaatatatatgatatgaatagtaaatatatggatgagatggataga

SEQ ID NO: 252 - DNA, 1449 bp, Plasmodium falciparum
atggattaccacatggattatattccgaatgaggtaatttctcatcaaggagaaagatttgtcgacaaatatgttgatagaaaaattttaaagaataaaaaatcattgttagttattatttcattatcagtactttcagtagttggttttattttattttattttactccaaattttagaaaaagtgatttatttaaaaactcttcagttgaaaataataatgatgactatataataaatagcttgctaaaaagccctaatggcaagaaatttatcgtctcaaaaattgatgaagccttatcattctatgataataaaatgaaagatataaataaaaacaataacaataatacttcatccgattttaaaggtcttagcttatttaaagaaaacaaaccatcaaataattttattcataatgaaaattattttataaatgtttttgatcataaattcttaatgaataatgtagaacatataaaccaattttatacgtttataaaaactaataataaacaatataattctccgaatgaaatgaaggaaagatttcaagtattcttacaaaatgcacacaaagtaaaaatgcataacaataataaaaagagtttatataaaaaagaattaaatagatttgctgatttaacttatcacgaatttaaaagtaaatatcttactttaagatcttcgaaaccattaaagaattctaaatatttattagatcaaataaattatgacgccgtaataaaaaaatataaaggaaatgaaaattttgatcatgcagcttatgattggagattacatagtggtgtaacacctgtaaaggatcaaaaaaattgtggatcttgctgggcctttagtagtataggttccgtagaatcacaatatgctatcagaaaaaataaattaataaccttaagtgaacaagaattagtagattgttcatttaaaaattatggttgtaatggaggtctcattaataatgcctttgaggatatgattgaacttgggggtatatgtacagatgatgattatccatatgtaagtgatgctccaaatttatgtaatatagatagatgtactgaaaaatatggaatcaaaaattatttatctgtaccagataataaattaaaagaagcacttagattcttgggacctattagtattagtatagccgtatcagatgattttccgttttacaaagaaggtatttttgatggagaatgtggtgatgaattaaatcatgccgttatgcttgtaggttttggtatgaaagaaattgttaatccattaactaagaaaggagaaaaacattattattatataattaagaactcatggggacaacaatggggagaaagaggtttcataaatattgaaacagatgaatcaggattaatgagaaaatgtggactaggtactgatgcattcattccattaattgaataa

SEQ ID NO: 253 - DNA, 1479 bp, Plasmodium falciparum
atggaatatcatatggaatattcaccgaacgaggtgattaaacaagaaagagaagtatttgtaggaaaagaaaaaagtggcagcaaatttaaaagaaagagatctatttttatagttcttacagtatcaatatgttttatgtttgctttaatgttattttattttacaagaaatgaaaataacaagaccttgtttactaatagtttatcaaataatataaacgatgattacataataaattcattattaaaaagtgagagtggtaaaaaattcattgtatcaaaacttgaagaattaatatcttcttatgataaagagaaaaaaatgagaactactggagcagaagaaaataacatgaatatgaatggtatagacgataaagataataaaagtgttagttttgttaataaaaaaaatgggaatttaaaagtgaataataataatcaagtttcttatagtaatctttttgatacaaaatttttaatggataatttagagactgtaaatttattttatatctttttaaaagagaataataagaaatatgaaacatcggaagaaatgcaaaagagatttataatattttcagaaaattacagaaagatagaattacataacaaaaaaactaatagtttatataaaaggggtatgaacaaatttggagatttgtcccccgaagaatttagaagtaaatatttaaatttaaaaacacatggtccattcaaaacattatcaccacctgtatcatatgaagcaaattacgaagatgtaattaagaaatataaaccagctgatgctaaattagatcgtatagcatatgattggagattacatggtggtgtaacaccagttaaggatcaagcattatgtggatcatgttgggcttttagtagtgtaggttctgtagaatcacaatatgctataagaaagaaagcattgtttttatttagtgaacaggaactagttgattgttcagttaaaaataatggttgttatggtggatatataactaatgcttttgatgatatgattgatcttggaggattatgttctcaagatgattatccatatgttagtaatttaccagaaacttgtaatcttaaaagatgtaacgagagatatacaatcaaatcatatgtatctataccagatgataaatttaaagaagccttaagatatctaggacctattagtattagtatagcagcttcagatgatttcgccttttatagaggaggtttttatgatggagaatgtggagcagcaccaaatcatgcggttatacttgtaggttatggtatgaaagatatttataatgaagatactggaagaatggaaaaattctattattatatcattaaaaactcatggggatctgattggggagaaggaggatatattaatctagaaactgatgaaaatggatacaaaaaaacttgttcaattggaacagaagcttatgtaccattacttgaataa

SEQ ID NO: 254 - DNA, 1455 bp, Plasmodium falciparum
atggattacaacatggattatgctccccatgaagtaatttctcaacaaggagaaagatttgttgacaaatatgttgatagaaaaattttaaagaataaaaaatcattgttagttattatttcattatctgtactttcagttgttggttttgttttattttattttactccaaattctagaaaaagtgatttatttaaaaactcttcagttgaaaataataatgatgactatataataaatagcttgctaaaaagccctaatggcaagaaatttatcgtctcaaaaattgatgaagccttatcattctatgatagtaaaaagaatgacataaataaatacaacgaaggtaataacaacaataatgctgactttaaaggtcttagcttatttaaagaaaacacaccatcaaataattttattcataataaagattattttataaatttttttgataataaattcttaatgaataatgcagaacatataaaccaattttatatgtttattaaaactaataataaacaatataattctccaaatgaaatgaaggaaagatttcaagtattcttacaaaatgcacacaaagtaaatatgcataacaataataaaaatagtttatataaaaaagaattaaacagatttgccgatttaacttatcatgaatttaaaaacaaatatcttagtttaagatcttcaaaaccattaaagaattctaaatatttattagatcaaatgaattatgaagaagttataaaaaaatataaaggaaatgaaaattttgatcatgcagcttatgattggagattacatagtggtgtaacacctgtaaaggatcaaaaaaattgtggatcttgctgggcctttagtagtataggttccgtagaatcacaatatgctatcagaaaaaataaattaataaccttaagtgaacaagaattagtagattgttcatttaaaaattatggttgtaatggaggtctcattaataatgcctttgaggatatgattgaacttgggggtatatgtacagatgatgattatccatatgtaagtgatgctccaaatttatgtaatatagatagatgtactgaaaaatatggaatcaaaaattatttatccgtaccagataataaattaaaagaagcacttagattcttgggacctattagtattagtgtagccgtatcagatgattttgctttttacaaagaaggtattttcgatggagaatgtggtgatcaattaaatcatgccgttatgcttgtaggttttggtatgaaagaaattgttaatccattaaccaagaaaggagaaaaacattattattatataattaagaactcatggggacaacaatggggagaaagaggtttcataaatattgaaacagatgaatcaggattaatgagaaaatgtggattaggtactgatgcattcattccattaattgaataa

SEQ ID NO: 255 - DNA, 2409 bp, Plasmodium falciparum
ccattggataataaaagcaaaattgtaaactctgccgaagttaaggaaacattagctttagctgaagctgctgccaacaagtacaaaagccccaaagtggatgttgaacatttgttaagtggattatcaaatgatgaattagtaaatgaaatttttaatgaagtttatttaaccgatgaagccattaaagcaatattaaaaagaaaatttgaaaaaacgaaaaaggataaagatggaaaaaccggaactttatacattgaacaatttggttccaatatgaatgaaaaagtaagaaatggaaaattacaaggtatctatggaagagatgaagaaattagagcaattattgaatctttgttaagatataataagaacagtccagttttagttggtaatcctggtactggtaaaacaacaattgttgaaggtttagtatacagaattgaaaaaggagatgtaccaaaagaattacaaggatatactgttattagtttaaattttagaaaatttacttcaggaacatcatatagaggagaattcgaaacgagaatgaaaaatataattaaagaattaaaaaataaaaaaaataaaattatcttatttgttgacgaaattcacttattattaggagctggtaaagccgaaggaggtacagatgcagctaatttattaaaaccagttttatctaaaggtgaaataaaattgattggtgcaacaactatagctgaatatagaaaatttatagaaagttgttcagctttcgaaagaagatttgaaaaaattcttgtagaacctccttcagtagatatgaccgtaaaaattttaagatctttaaaaagtaaatacgaaaacttttatggtattaatataacagataaagctttagtagcagcagcaaaaatatcggatagatttataaaagatagatatttaccagataaagctattgatttattaaataaagcttgctcctttttacaagtacaattatcaggaaaacctagaattattgatgtaacagaaagagatatagaaagattgtcatatgaaataagtacattagaaaaggatgtagacaaagtatccaaaaagaaatataataaattgattaaagagtttgaggagaaaaaagaacaattaaagaaatattatgaagaatatgttattacaggagagagattaaagagaaaaaaagaaattgaaaagaaattaaatgatcttaaagaattaacacaaaattatgtatattcaaataaagaaccacctatagaattacaaaatagtttaaaagaagctcaacaaaaatatttagaattatataaagaaacagtagcttatgttgaagcaaaaacacacaatgcaatgaatgttgatgcagtttatcaagaacatgtatcatatatatatttaagagattctggtatgccacttggttctttatcatttgaatcatcaaagggtgcattaaaattatataatagtttatctaaatccattattggaaatgaagatattataaaatcattaagtgatgctgttgtgaaagcagctactggtatgaaggatccagaaaaacctataggaacctttttatttttaggacctacaggtgtgggtaaaactgagttagcaaaaacattagctattgaattatttaattcaaaagataacttgattcgtgttaacatgtcagaatttacagaagctcactctgtctccaaaattactggtagtccaccaggttatgttggtttcagtgactctggtcagttaaccgaagcagtccgagaaaaacctcactccgttgtactttttgatgaattagaaaaagcacatgccgatgtctttaaagtattattacaaattttaggagatggttatattaatgataatcatagacgaaatattgatttttcaaataccattattattatgacatctaacttgggagcagaattatttaaaaagaaacttttctttgatgccgacaattcaggtactccagaatacaaaagagttatggaagatgtcagattatctcttataaagaaatgtaagaaagtattcaaaccagaattcgttaacagaattgataaaattggtgtatttgaaccattgaataaaaagaacctacataaaatcgttgcattaagatttaaaaaattagaaaagagattggaagaaaaaaatattcaagtatctgtttctgaaaaggctattgattatattatagatcaatcatatgatccagaattaggagcaagacctaccttaatatttattgaaagtgttattatgaccaaatttgctattatgtatttgaagaaagaattagtagatgatatggatgtatttgttgattataatagtaaagctaaaaacttggttataaacttatctaagacctaa

SEQ ID NO: 256 - DNA, 2064 bp, Plasmodium falciparum
atgaaacatacaaaaataaccaaatatttgacaattaatttttttatcctactaactttagtttttcaaaaatattcaagttgtcaaaattcgttgaattatagtaaaaataactatggattaaatgaccaagagctccgagcaatgctatttggtcttaattatgatccatctaaaaggaataaaaataataaagtaaatagagatgttataaaaaatgaatcatcattattattacgtaatcttatcaatgaagaaactctaagtgaaaaaaatgacaaagttgtaaatgatattaaaaatatgaataatagcacagagaaaaaaataaatagtatatcaaaaggaaataataatatacataatataaatgaaaatcaaaatgcaaatgttgaattaaaaactgataatatactagataatacatcagaacaagacgatataaacgaaaaaaataatgacaatggtgatatggttcataaaaatatttataataatatacttagtgatccttatgatattaatagcaccaatgcatacattaataaaagtgacataactaatttaaattattcttcaaatgatgttataaataatgataaagtcaataaatcttatgaagaaaaaaatattgttaataatacagagttaaataaattaatagaatccgacgaccattcaaataaaaacgatattaataaaaaaacagaaaaaaataaaacctttaattcatcatctacctcagatgaaaaaaagcaaacagatataaaaggacaaaataaaaatgatttaaataatgaacatatttttaataacaatgatattaataataatgtacaatataaaaataaagtaaatatcatatctgtagacaaaaataatacagatagagataataacaatttatatgaaacaaataacggtgatttaaaatataataatgatttaattaaggaaggggaaaataaaagaaataataaattaaataattataaatttaatatgaataaagtaaatgataataaaaactttaataagtatacagaaatatataataaggaatcagaaccagaaaaacaaaataatagtaacaataacttaggaatacctacattgataaagaaagaggtgcatattaaaaatcacaatacattttcatctaatggaaagatcttagaaaacaaagacattgataaaatgtctgatacatcaaaaaaaaatgatagaaattttagatcaaatgatattaaaaattttaagaataatgatacaaaaaataatgcaacattatcagaggataataaaaacagatataacattacaacgaataaaaacaatgaaaaaaaagaatacaatatgaagaaatcaaatgaaaatgaatatgcttttaatacagaaaaaacaaatgtaaataatgacgcattgaaagaagaaagaaataactacaaatatttgaataatcaaacagatgtaaatatcaataatttacaagaaagagatataaatttatacaacaaaaatgaatcagataaaaaattggagcaatcgtttagggaagaagacattaaaaatgcatatttacctgaaaataaaaattttcaaaagacattaacaaataacgaaaaaaatgaagataataaaatacctcatattgatccttctaataatgaattagataaaaaaggaaattacaataaatatgaaatcggaaaaataaaaaaaaataacgaagaaaataagcagaatgttacagtagaggaaaatataaaccctgaaaaaataaggaaagatcatgaacaaaatattcaatattccaaaaatgatccaataacggatattcaaaattctacaaatgctgtattaaaaaaaataaaaccaacagaatttgaaaactatacaaaggaagaattacaaaatgtttcatcttcagaagtaagagatgataatttaaatgaaataaacagaaagggtgaaacaaatatgttttcagaaaaatcgactttaaaaaaaggggaaaatgattggaatgaatatgaatattttaaattgaaaagtaatgaatta

SEQ ID NO: 257 - DNA, 2055 bp, Plasmodium falciparum
tttctttctgattacactacttgttcagtgaatgcgaatattatgcatgatgcaatatcatatacattaagcatagaatcaaatggttatttttttgaagagttttttaacaagatacaggaattgttatcattaaaagaaattccttctcgtgatgaatataatgaagcttatgatgaactaaatataattatacaaacagatacaacctctggagtagataagtctttaaaaattatgtattcgttatttaacaaatatactccaactaataaagaaatgtatgatattttgaatgcatattttttttatccatcatataatgcttatagaacatatgtaaatgaatattttcttagaaattatgttgtcatttttatatatggaaatattatcatatcagatttaaaaggtgaagaaaatattaccaaaaataataataacatttttgataataagaaaagtatgaactataatgaaggtgatgcaactgataaaaataataacagcaataataacaatgttgaaagtgctaatgatagcaccaattattatatatataatgaaaataattcttccaatagagatacaaataagtacactgacaatgattataataataataataataataataataataataaggatggtgataaatatttaataaatgaaaaaatttatgaaggagaagaaaataaaaagaatcctactacttatttaaagaaacaggaacagtttttggaaaaacaagaaaataataataaggaagaagaaaataaatcaaaatcacttcaaatatcttataatggatcaggaattgaatatttagtaaaattatgcgaatcttttataagcaaagtaacaaataaggttataaaaaaaagtgaatctacatattatacaaagaaattaattaatgatgaagatattgaaatagatatgcatgaccctggacaagatttaagtaattcaataacagtatcatatataatagattcagaaactttgttgaataatgttttaataaacattatagttgatttaatttcatctgattttattaaatttgttaaaataaaatataatgatggttatgttgttgaggtaagaactttttttacatataatggattaggtggattactttttataattcagagttttgataaagatgtagaacagcttgaatcagatatatgtacatttgttaaatatattacatttcaattattaaatattgatatatcagatttgaagaagcagttgcaaaatatgaaagaacattatataatgaataatactatattcacatttaatcaagaatattcatctatattagatgaattaattacaggacatgaatgttttgacaaaaaatataaaattgtacaaatatttgatgaattaattaattgtcctaacattattctaaataagataaattatattttaaggaaatcaaaaaaaaatatatttaaagaatataaaaaaacaaacatagttaatatacaaagtagtaataaagatggaacaaaaggtcatgattatttacacttaaatgaaaagtgcaattattcatataggaaaaatatgaaaatgtctaatatacaattttcggataattcagaattatttattaaaaaacaaagaaaaaagaaatataaatatattccaagtaatggaacaacacaatcaaataatatatataaaaaggaacacctatttaatttctcaaattttgttgaaattaaagaaaagggattttttaaatatattattagctactttaggaaaaataataggaaatatttgaatgatgataattatttagatttcgaaagctgcgacgaagaaatgtcgaaagacaactttcaaatattttacaacttcacaaatgatataaataaaattagagaatattttcgtgggaagtttactaatgataaggaggtaaaagaaaattgttctatcaattatgaagaaattagaaaatattgttatgatcataatatcaataaagataacatgataagaacaaaaatagagatatga

SEQ ID NO: 258 - DNA, 2619 bp, Plasmodium falciparum
aataacgtaaaacatactaataataccaataataatgatacacatataacagatacactaacacatataaatgaaaataatgatactagaaataattttttaaaagtaaaagataaccataagattgtagattttataaatgaaaataaattgaaatttctagattatatcgatcctaatatcatgaagaaattaagaaattatatcaacctcttaaatacagaagaattaaatttaaaaaacaaaaaagataacaaaaaaatagatgattcaaataaaaaagatttattaggaattaaaaaaaaaagaagtgaagataaatttcatttagataataatttagagaaagatgagaaaaaaattgaagtaattaaaaatttattaattttttatcataaacttaaaacggtttgcttgtctaaaaaagaaaaagaattaaaagatgaatttataaaagaagaaaaagaaagtattaagaaattaaaattaaattataataaatttgtaaatatcaaaaagaatttagaagtatctaatgtttatttacataacaatggatatgattcatcattaaaagaacttgaaactacaaaaaaatatcttatagaaataaaagatgaagttacaaaaataaaacaaatatcagataatattattaaaatagataatgtagaagaattaaataaagatattgaaaatttaaataatgaaattcatgaaattgaaaagatgtggctatttattaaaaaaaaagaagaaatattaaatgaattttttttttgtccttttaaagatttagatgtagaagattttgatatacaaataaaaaaattacaaaatgatttcaaaaaaattaaagtagatagaaaacataatatatgtaaagaagaaacattaaaattaaaagaaattataaaatttatttctgttttgtgtgaaattaaaaaaccatttataaaagatagacatataaaagaaatggaaaataatataaatgaagaaaaagaaaaaaataaagaagaagataaaataaatataattatagatgatagtacattaactatatatttctataaattaaatattatgaaatatcatgatactattgaagaagttattataaaagcatataatgaaaaaataatagaagaaactattaataaatttgaagattattgggataaaatatattttaaaaaaaaagaatataaaaataatatactattaacatatatagatgatatatgtatagacacaattgaagaacatcaagttactttacaaaattgtttttcatctaaatattttcttttcttttcagatgaattaaatttatggcaaaaaaaaatatccaatatatatgaagtaatacaattattaaaagatatagaaaaattgtggatatatttacaaaatatgtatatatattcagaagaagtaaaaaaggaactacctctctattctaaattctttttaactattaatgatgaatatcttgaaatgttaaaacaaattattgataataatataaaagtagtagatttttcaaatgaagggggaattatagaaaaattagaagaattaaaagtaaaattatgtaaaagtgaaaaaccattgaatgaatatttagattctaaacgtaaatcatttcctagatttttttttatatcttctactgatttaatagatatattatctaatggaaataattttaaacttgtaaatacacacgtacaaaaaatatttttatccattagaaaatttgtaacaaaaaatgaacaattaacagataacgaaatacaaaatgaagtgaaactaaataatcaagaaactattacagaagaaaagaataaaaatgcaaatgaaaattctaatgaaatagagacaaataaatataataagaaggaagaattaacgaataatagagatggtgatggtgatgatgatgataatataaaaaatgataaagatgaaaaagatgaaaaagaagaaactattatcaagttaatttcgtcttatggagaagaaatatgtaattttcatgaaggtctagttttgaaaggtaaagtggaatgttatttaaatgatataatagatcatattaaatatacattaaaatattatattacaaatttatttagattaaaagatttatttaataatgaaaaagaaaaatggatagatgaaaattatttagctcaagtatttattttatgtaatactatattttttgtaaatgatgtggaaaatatattaattaaaaaagatattaatatatatgaagaattaaataaatattataaaaatcatattcttcaattagaaaatgttattaaaaaagttcaaaaaaaattaactataaaaaatagaatcaaaattatgtgtattattacattagatacattttatagagatgtacttgaagttatcctaaaaaataaatcttctatttctataaatatgttcgattggcaatctcaaattaggatgtatccattttttaaaaatcaaaaaatttacgaacagaatgaaaaccaaacggaagaatcaaacttaaaattggataataaaaatttagataatgaacaccaagaaggaaaacaagaatataacaacaaa

SEQ ID NO: 259 - DNA, 2619 bp, Plasmodium falciparum
aaaatattaaatacaaaacttatatcttgtatgaattataatagaggcaattttactattaatccaagattaattagacacttttttatattaaatattaattttccagaaaataatacagtcaatagtatatttagtgttttattaaaaaatcattttaataattttaaacaagatgtatctgatttaattccatctatattaaaatctactatatctttattttataatattgaaaagacattcaaaagaacagctacttatttttattatgaatttaatttaagagatattcatagtatagttaaaggattacttactacaacacctgttacatttcaagattgtgataaacttttatttttatggttacatgaatgtgaaagggtatattcagataagcttaataaaaaagacaagaacaaatataaaaagattattactgatataataaaaaaaatgtataataaatatgaaattaataaatttgttatgaaatatgacagtactttattattttcaaattttcataaaggtagtcatgataaaacatatgacatttgtaaaaacatggaagaattaacattattcttaaatgaagaattaaatgaatataataattcctataatgtaaatattgttttatttagtgatgctattaaacatatttgtaaattaattagaatagtagataatttaaaagcacatgccttattattaggtataggaggatgtggaaaaacaaccatatctaaattttcatcttatatatcatcgaaaacattttttgaaatggatttttctgcacattgtactgataacgatatcaaaaaatatttacaaaacatttttcataaatgtgctatgaaaaatgaagatattgttttatttttgaaagaaagtaaaatacatgatactttctttatatatgtaaatgaatatatgtgttcaaataatattatagacttatatacaaaagaagaacgagattatataatacataatattagaaatatagctaaagcagatggtatagaacaatcagataataacatattcgattattatattaaaaaagtaaatgataacttacatttcattttatgtttttctccaactagtaataattttagagataaatcaaacaatttccagtgtatattaaataatactatgatagatatatatgataattgggaagctgattctttaatgtgtgtagggaaaaattatgttagtaatatatatatgaatataaatacgggggatattttattagatcaagaatatattaatttaaaaaataaaaatatagaaaaagatataactttgggaaacaaacaaatagagaaaaattatatccctacaatatcaacaaacgatggagatgatcattataaagacatggataaaacaaatatgaaaaatggggacattacaacaacgataaataatattcctattgataataataataataataataataatagggataatattgatggtaataattttttcaaaaatagagaaggaaatgatgaaaacatgaaaagaaaagtttatagtaataattttacgaaccaaaatgatctcaatacaaatattacaaacaataataataataatagtaataataataataataatatttatgataaaaatgatagtatactaaaggaagaagaatatgtaaacctaaaagatataataactgaatatctaaaagaatgttatgaagacctattagatatatcatccttttattattctcatgaacgttcccatatttatataacccccaaattatatcttgaaagtatcaaaacatatcatataatgttactaaaaaatattactaatataaataataaaatgaatatgcttaaaaatggtatcacaaaaatgaatgaaacaagttcaaatgtagaaaatataaaaaattgcttaaaagataaaaagaaaatatcagaagagaaaatggaagctgctgaaaaatatgcaatagatattggtaatgaaaaaatggttgtaaaaaaagagagtgatttagctgatatagaagaacaaaattgtttagaaatacaaaaaaaagttcttaaacaacaagaagaatgtgaaaatgatataagattaggtattccattaatagaacaagctgaagaagctttaaatactttaaataaaaaaaatattcaagaattaaaaactttaaacaaaccacctccaggagtagaagatattactgcagctgttatgcaattattagcaacaatcgatacaactatatctatagataaatttggaaaaattaaagatcgaagttggaaatctgcacaaaaaatgatgattaatcctgaaaaatttatatccttacttaaagattataaaaataagattgatgaaaatttggttcctgattgtaactttaaatatgtagaaaatttaattaatttaccacattttaataaaaatgcaatacaaaaaaaatctaaagctgctgcaggattagctgaatgggttttaaatataacatcgttttataaaattattcaaaacatattacctaaaagaatcttattagataatacaaaaaaaggtttagaagaagctaatgaa

SEQ ID NO: 260 - DNA, 2610 bp, Plasmodium falciparum
ataagcgaagaagaggaagaaatttttattaatcctaaatataaattaagtaataataatataacaagtattagaaataaaaaagagaatgaaagtatggaaaaaaaattaatgaataaatcatttattaatgaagaattatatgaagattgtaagaatctagaaaatttaaaagattttgaaaacattactgaaagtttcgaaagtgaaagtatgtcatggaaacaatggtttttaagtgaaaaagtagaaaatgaagaattacctagaaaatataataatataaaagatttttctaaattattattaattcgagttttacgtaaagatagatttttaattgcattaaaaaattatattacaaaaaatataaaaatgacaaatgatgaaaaaaataatacatatgcattagaaaatatattagatgaatatattgataataaaacacccgtcttatttttgttaacaactggttatgatccttctaaagaaatagaagattatataaataaaatgaaaaataatgctattaaaaaaaatgatagtaataaaaaagaatccaataaaaataatatagcttatgtaaacatatctatgggtcaaggacaagaaaatattgcattaaaatatttaaaagaaatatcaaaatgtggaggatacatatttttacaaaatattcatttaatgacaaaatggttaaaagaatttgaagaaattctggataaaatatttttagatgctcatgtaaattttcgtttattcttatctgcagctataccaaatgaaaaagataccaaattattacccgaaaaattattaaagaaatgttttagaataaataatgaaaaatcatatagtttaaaagataacataaaatgttgtcttgataaatttgaaaacggacaatatgatgataaattaaaaacagtaatattgggtctttcttattatcatagtttattattaggaagatttttatatggaaaaatcggatttagtcaatcatactcttttaatgataatgatttagaaatatcatttaatattattaaaagatatttaaaaacatatgaaagttttcctttagcagatgtattatttttaataggagaaattatatatggtggacatataacagatatatgggatagacgaataaataagacatacgttaagaatatacttaaagagatatatagaaatataataagtataaatgaaaaaaataaaaatattaatatggattttcatcaccccaatgatagtaataataattataatgatgatgataataataatagtcataaaaataataaaaataataataataataataataaggatgatgatgatgaaagtaataatagtaatgataacgaagaagaaaatgaagaaaaactcattttaaaaaataccaaacataatattctgttcgatgtatttaagtttccggattgtagtaaatataatattaatcaactaaaaaaatatatagacgaaaaattgaataaagaacaaacttatttattagggttacacataaatgccgaaattgaatatatgaaaaatgaatgctcacgaatattacaaactttacaagaactaagtaataaagaaattgcatcaacagaaagttataaaaaaaatacgaaaataataaagaaagaaaaacctggtgataataaagataataaatatacacatgatcaaaaaaaggaaaccatacataaagaggaagatgatgaagatgaaaaacattcaggaagtaataaaagtacaaaaattatatatgatataattaatcatttattaaatgaattaccagataaaattgatacaaatgatttaaaaatagaggatagtcaaacaaatacatttatggtaatagcattaaaagaagcagaaaaatttaacaaattaatagaatgtattaatgatacattaatagaaattaaattagtattagatggtatattaaatatgaatgataaaattcaaaatactatcaaatcattaatgttacataatataccacatatatggataaattattcttatccatcaaaaaaaaaattgatgccatggtttgaaaattttaaattaagaataatatttataaaagaatggatttctaaaataagaaataatatatttctaccaaattctgtatggttatctgcattatttaatcctatctcatttctaacagctattaaacaaaaatttgctcaagaaaataaagtaccaattgataaactcaaattaaaatggcaagtaaccaatataacaaaattagaagatttaaataataaaaataatgcattatatatacatggattatatttacaaggagcttcttggtttattaattcgaaaaatgatacctttacattcgataaggataatataaatgataatgtatcttatggaaacataatagaatctgtacctaaacatatatattattctatgccattaatttatgtatattgtattagtaatgaacaagatgaactcttaaaagaaaatatggaatatcgttcattggatacacctctttatgtgacttcagacaggggaaatacttttgtttgttcaatagatctaaat

SEQ ID NO: 261 - DNA, 768 bp, Plasmodium falciparum
atgaatgaaccttttagtttcaatgtaaatgctccttcgtattatcctggaatgaaatataagggagcaggggcagaggaagatgatgaaaacaatagtaacctcgacaatacaaataatgagaataatattaatatgaacaatgatgttaataatgatttggataaaattaaagaagaggaagatataaatggttccgaaattgtcgaagatgaaaatgttaatgatatagaagaaaaaataagcaaactggttttgaatgatgataatgatattatgaaagacgacgtagaagaattacaagaaaaagtagaagataaaaaaataaaaatggctgaagtagacccaagaccacacttaaatataatttttattggacacgtcgatgcagggaaatcaacagcttgtggtaatattttatatatattgggatatgttgatgataggactattgaaaaatatgaaagagaagctaaagaaaaaagtcgagaaagttggtttttagcatttattatggatattaatgaagaagaaagacagaaaggtaaaacagtagaagttggaagggcacactttgaaacgaaggatagaagatttacaattcttgatgcacctggacataaaaattttattccaaatatgattagtggtgctgcacaagcagatattggtgttttaattatatcagcaagaaagggtgaatttgagacaggttttgagagaggaggacaaacaagagagcacacattgttggcaagaacattgggt

SEQ ID NO: 262 - DNA, 381 bp, Plasmodium falciparum
atgaaactagtacattttttgatgaaattgacaaacgaaaatgtaactatagaacttaaaaatggaacattaataacagggataataacagcggtagacataaaaatgaatacacatatgaaaaatgtgaaggttgttataaaaaataaaaatatagctgaatataatgtaaataccaaacaatttttatctttagagcatgtaaccataagaggtaataatataagatattttattttatcggatagcttacccttggattcattattagttgaagatacaacaccaaaaaaaatatctaaagataaaagctttttacatcgagataaaggaatgtccaaaggtgctaaaggacgaggaagaaaattatcaaaaagataa

SEQ ID NO: 263 - DNA, 1545 bp, Plasmodium falciparum
gatagtttacaaagagtatatggtataagttttcaaaaaaagagtgaattagtagaatatttaaaatttttagaagaagctaaaaaaagagatcatcgtaatgttgggaaaatattgaatttgtttttttttgaaaaagaaacatcaccaggttcatgtttttggttaccacatggttcaaaaatatataataaattaatagaatttataagaaaagaatatcgtataagaaagtatgaagaagttatatcaccaaacgtatttagttgtgatttatggaaaacatcaggacattatcagaattataaagattgtatgtttttatttaacgttgagaataaagaatggggaatgaaacctatgaattgtccaggtcattgtttaatgtttaaacaattaaatgtttcttatagatcattacctgtacgtctagcagattttggagttttacatagaaatgaaatatcaggaagtctgagtggattaacacgtgtaagaagatttcaacaggatgattctcatatcttttgttcaatggaacatataaaacaagaagttctaaatacattaaattttctcttttatgtttataatttatttggattcaaatatgaattattcctttcaacacgacctaagaaatttataggacaaatatctacttggaatctcgcagaacaacatttaaaggatgctctatacgcagcaaatgttcagtggaaaataaatgaaggagatggtgctttttatggaccaaaaattgatatactagtaaaggatagtttaaatagaacacaccaatgtggaaccatacaactggattttcagttacctgttcgatttaatttacaatataaaaataaagaatatgtaactaataacgaaaaaaatgaaaaaaatgaaaaaaatcatgacaatgatgataatgtacataacaataataattatcctattaatcatgatgatcttcataacaatgaaaagaaagaatttaaagattcacaaaatcataatgaagacaaagaacataataatatacatgataatcattcgttaaagccaaatataaatgaagaaggattattaaaaaaaggatttgaaagacctatcataatacatagagctattttaggttctgttgaaagatttgttgctatattaatagaacatacagctggaaaattacctttctggttatcaccaagacaagctattgtcttacccattggtgataaatataatgattatgctaattatgtatatgaaacattgcataataatatgtttgatgtagatctagatacctccgtcaatacattaaacaaaaaaataagagaagcacaattaaaacaatttaattatattctagttgttggtgaaaaggaattaacaacgaacactgtaactttaagggatagagatgatcaaaataatcaacatgtctataccattcaagaattaataaacaaatttaataagctattggatgtaaactctaagaaatttaaccaaataaaggaatttaactcaaaccaaaccatttaa

SEQ ID NO: 264 - DNA, 1881 bp, Plasmodium falciparum
atggatatcgagaattcaaaaaaacacctaagcgaattacaagaagaaagaagaagacacaaaattacacttcccgatatgtttaaaaggaaagttcttataaaggaagaaaataatgatacttatgaaaagaatttagagacaaaaaatgatatgtgttattcattgaatagatcagatgatgagaaggaatatttaaaaatgaaattccctaatattattaataatcctattataaaactttatactgatccatattacacaatacatatgtcagataaaaaaatgaatacaacagattcaataaatacttcaatggatatgtctagttataattatactacaaattcttttatgaaagaaatgattaatatgtataaaccacatgagaaattaaatataggtattttatttacaggacaacaaactccaggtggtcataatattatatgtggagtttttgattgtttaaaaaaaaaaaataaaaaaaatactctttatggatttatgaacggatttcaaggaatgctcaaatataactttatggaattaaaaaatgaatatatcagtatgtttagaaatagtggaggatttgatatgattaaaagtagtgatatacaaattattaacgaagatcagaaaaaaaaatgttttaaaatatgtagacaactcaatttaaatggtcttgtcattattggagatgtttcaggtaataaaagtacagctatcttatctgaatattttgagactgtttataaaattacaaatgaaaagataaaaagtcaagaattaaaagaaaaaaataaagaagaaacaaaatgtaaacaagatggagaaaaaaatgaaaaagaagaacaacaaaatgaacaagatgacgaaaaaaataaagaacaacaaaaatgtaaacaagatgacgaaaaaaataaagaacaacaaaatgaacaacgggatgacgaacaaaataaagaacaacaaaaatgtaaacaagatgacgaacaaaataaagaacaacaaaatgaacaacgggatgacgaacaaattaatatggaggacaataacaatatatgtgaaatactcaaaaattatgtacaagaagataaaatatataaaccatataatataatagataataataaaacatgtgtatcaaatgaaaataagagcaataataatattccatatgataatatacaaagttataatatgtcttatgataatatatcaacttatgattttacttatgataatattagcgatataagtgatgaagaaattaataaaaaatatcccaaaaaaaataaaagttttgtaaaaacttcaattgttagtgcaccaacatgtgtttataatgaaatgaaaaataaatatattgaatgctctctagggtttgatacaactatatttagttattgtcaatatataagctatttaataacacatatacaaacatatcttcaaggatatcattttataaaagttatgggaaactcctctagtcatattgctttagaatgtttcttacaaacaaaagtaaatattatattagtcactgaagaaatcaaaaaaaataatttaacgcttgatcaaattatacaattcattgttgatgttattcaaaatagatacaaaaaatatcataaaaattatggtattgttattatacctgatgggatattgaaaaaaattacacaatttaaaaaattagtaacatctattattcatataaaaacaaaattcatagaaaataaaatcaatattttaacagatttacaaaatattttaagtaaacatttaataaaggaacaacaggaattttttaaaacacttcctgatttttttcaaatacaattactggaggaaatatgttcccaacaatttcac

SEQ ID NO: 265 - DNA, 1359 bp, Plasmodium falciparum
atgattaaaataatattagctagctttttatttttcttttatttttcgtcttccatttatgggaatgtggtggcccctaagagtgctgaggctgttcatacgttgacagcaaaacttgatacggaaaataaggctcatcaaaaatatatagatattataaatggagttttttcggaaaatatggagaattttgttttttcaataacaaccagtaacggatttacatgttcgataaataagttggatgttatttttgataataaagtaacaggaatgcaaaaagttttttctgatgagaatgttcaatatattaaagaagcttctcttgaatttaaaaacaatttgttggaatatatgaaaggtgttatgccatctgaaaatgatttttctaatgttagaaaagaatttcaaaaagtatgtgtaaaatatttttcagagttaagaagaaaatttttccagatatatagagaccccaataataagaatcaaaacgaagataatgttgataatcatatgaatattgaagaaataagccaagaattcttctctggttttaatccttttggaactatgaaaataagaaaagaacaaaatccagatttatcacaaaaggatagtttgatattaaatgaaaataataatgattctcttacatcagcagatcaaaagaataataatatggttcctatggaaaatagatcattttcatattctcaacaaagttcacatgttgtaagttttgatggtcacgatgaacatgttgaacaacaagagcaacattctggagataatacacaagaagacaaagatcaacttatggacttaccatttaacaaggataaagttttttcaaccttcttaaaaaatgtaactcttttaattgaaggaaattgtacagaagctcaacaacaagctcaagaacaaactcaagaacaaactgaagaacaagaagaagaacaaaatgaaaaagaaattgaaagtgataaacaagtacaaaaagatggagaacaaaaagaaaatgatgtacaaaaaaaacaaaaagctaatgctttcaccattcaattttcaagtagtcttagcagaaaacatatatctacaacatgtaatgcttcatcaggtaatgtcttcttaagaaaaggaaacaaaccatttgaacattttaatagtcctaatttcgaaaatatgatgaaaggagtttttggaattattcaaaatccttttgaaaatggccaacccactttcccattctttaaaaatattaattcgatctctggaatcggtaatgttgatatccccaaaaattttatgaatgattttttgaataatggaaatgatcaaaacacaccaatatcgagctaa

SEQ ID NO: 266 - DNA, 2976 bp, Plasmodium falciparum
aaatatataaaagatgaactaaataacaatgacaataacaataatctgttaaatatccaaaatgttgaaatcatggaatatgctgaaagcataaaaagtgataacataattaatgatactaaagaggatgctctacccagaaacgaaaccctcaattttctcaaacaagaatatgtatcaagtaaagaacaagaagaaaaaaaagacgaagaaaaaaatattttaaatgaacaagaattaaatgacataaacgaaaaaatgaaacaacaaaataacgttgattccaaattacctcattttgctattgaacaaagaaaaaaattaattaaagaaacaaaccgattttttaaaatgtataatttacatttaaaaattgaaaagttacctattaatattccgaatgatttaaaaatacttatgcagaaaaaaaagaaaattgtcgatattattaatgattacaaaattgtttttaaaacattacagaaatatgctgaaaaggaaaaaaatatttcggaagaacaagatggagaagaaagaaaactgtcacatgataatctagataaacaaaaagaacaacaaaatgatgaacatgataataataatgatagtaataataatgaaaataataataatgaaaataataataatgacaatattaataatgacaataacaataatgacaatattaataataatgatatatgtattgatcataaagtaacaaataatatggtgctaaatacagatggagatgaacaaaataaagaacaaaacatatcttcccaaacggataaaggaaatgtaattcttacgacaaaggatgaaacagttgttaataaaaatgacatatcatctgtattaaaagaagaaaatgaagacaaagaaaataaagaaaattccacacataaagatccggatttatctcttgatgtaaatgctgaaacaaaagaaaaggtacccagaagaagaggaaggaaaaaaaaattagaaaaagaaatagaagtacatgtaggaaaaagaagaggaagaaaaagacaaactgaagatatattaaatgataataacattaacgatgatagcttatattatttgagtgatagttctaaggaattaatagaaaaggaatttaataagtttatgaacatatttgaaaacattaacagaaataaaccaaacgaatcaaatgaatcaaatgaaccaaatgaatcaaatgaaccaaatgaaccaaatgaaccaaatgaaccaaatgaaccaaatgaaccaaatgaatcaaataaaccaaatgaatcaaatgtaccaaatgaatcaaatgtaccaaatgaatcaaatgaatcaaatgtaccaaatgaatcaaatgaatcaaatgtaccaaatgaaccaaatgtaccaaatgaaaacaacgaatccaatgagaaaaatatgaaaacattctctaatatgaatgatacttttaacgatcaacaaaaagatgaagttattgacgatgctactacatgcacttttatggatctaaataattgtacatatggagataacaagaataatacaagtgagtacaacaagaatgataaacaaacaaacaaagaacaataccgaccaattgattatgatgtagagaaggaaatacaaaattctgaaaaatcagaatattttgataaatatgaaaattcttttattcatcaacttataaacgatttaatacataataatttagaagaagaaaattatatacaattctcaaatatagataatgaagaaataaaatacagaaaattaaaagaggtaataacaaacctaaaaataaaagaaaaaaaaatagacttaattttaagtaataatttgagttttttcaaatattcctgtatgtatagaaagcgtcaattattacatgagaaaatgttaggaaattggagttatgtagaaaatacaattaataaaagagatgatattagaaataaaaatttgccttttcaattattaaaactagaacaaaatatgttagaaaatatttctaaatgttatgatgatatattattagaagatttctctggtattattataacgttaaatacaaattcttttgaaagagaaacagatggaaaaattattaaggtgtcaaaagttatatgtggatgtttaattgaatatctagataatacatcagaattaaacataaaatgtatatgggcacatccatttttaaatacaaaatctacttattacattttgtgtgcattcttaccaagggttattttagaagcatttttaaatagtaaaggaatattacataatgatataaatgataaagatcatataaatatggtcaattctgtaaagggggaagggttagaaaatatgaattctgaaatgtgtgaattcaaaaattccgaaaaaaaaaaaaaaaaaaaaaaaagtttttatgatagattaaatgaattagatatggaaaaaatcaagaacgatcatcatgaaaatgataatattaataattctcataacaatattatcaaattagaacaagcatatttctcaaactattctacatatgaatatcctttaacccatcttttaaattttaataaagagtgtgcatatgccttaaattataatgagaaccttttcaaagataatgaaaataagcaagacaatatcaacacatgtaataatatgaaaggtcataataattgtaacgataatacatcattatcttctaaagatagtaataacaaatttttgtatataatatttagtgatattgatatatttccaagacagtgctatttaattttatgttcatacaagtatatgtgtttaaatatgcactatgatacagataattattctgttcattatgatttagaaaatatgaaaaaggaaaacgtggggaaaacgacagagttatctaatagttgtccttgcaaatgtatgaaatctattcccgatgattctgaagaatcctatgagcgtataataggt

SEQ ID NO: 267 - DNA, 1869 bp, Plasmodium falciparum
atgagaaaattatactgcgtattattattgagcgcctttgagtttacatatatgataaactttggaagaggacagaattattgggaacatccatatcaaaatagtgatgtgtatcgtccaatcaacgaacatagggaacatccaaaagaatacgaatatccattacaccaggaacatacataccaacaagaagattcaggagaagacgaaaatacattacaacacgcatatccaatagaccacgaaggtgccgaacccgcaccacaagaacaaaatttattttcaagcattgaaatagtagaaagaagtaattatatgggtaatccatggacggaatatatggcaaaatatgatattgaagaagttcatggttcaggtataagagtagatttaggagaagatgctgaagtagctggaactcaatatagacttccatcagggaaatgtccagtatttggtaaaggtataattattgagaattcaaatactacttttttaacaccggtagctacgggaaatcaatatttaaaagatggaggttttgcttttcctccaacagaacctcttatgtcaccaatgacattagatgaaatgagacatttttataaagataataaatatgtaaaaaatttagatgaattgactttatgttcaagacatgcaggaaatatgattccagataatgataaaaattcaaattataaatatccagctgtttatgatgacaaagataaaaagtgtcatatattatatattgcagctcaagaaaataatggtcctagatattgtaataaagacgaaagtaaaagaaacagcatgttttgttttagaccagcaaaagatatatcatttcaaaactatacatatttaagtaagaatgtagttgataactgggaaaaagtttgccctagaaagaatttacagaatgcaaaattcggattatgggtcgatggaaattgtgaagatataccacatgtaaatgaatttccagcaattgatctttttgaatgtaataaattagtttttgaattgagtgcttcggatcaacctaaacaatatgaacaacatttaacagattatgaaaaaattaaagaaggtttcaaaaataagaacgctagtatgatcaaaagtgcttttcttcccactggtgcttttaaagcagatagatataaaagtcatggtaagggttataattggggaaattataacacagaaacacaaaaatgtgaaatttttaatgtcaaaccaacatgtttaattaacaattcatcatacattgctactactgctttgtcccatcccatcgaagttgaaaacaattttccatgttcattatataaagatgaaataatgaaagaaatcgaaagagaatcaaaacgaattaaattaaatgataatgatgatgaagggaataaaaaaattatagctccaagaatttttatttcagatgataaagacagtttaaaatgcccatgtgaccctgaaatggtaagtaatagtacatgtcgtttctttgtatgtaaatgtgtagaaagaagggcagaagtaacatcaaataatgaagttgtagttaaagaagaatataaagatgaatatgcagatattcctgaacataaaccaacttatgataaaatgaaaattataattgcatcatcagctgctgtcgctgtattagcaactattttaatggtttatctttataaaagaaaaggaaatgctgaaaaatatgataaaatggatgaaccacaagattatgggaaatcaaattcaagaaatgatgaaatgttagatcctgaggcatctttttggggggaagaaaaaagagcatcacatacaacaccagttctgatggaaaaaccatactattaa

SEQ ID NO: 268 - DNA, 1992 bp, Plasmodium falciparum
atggcatcactcaataaaaagaacattgtaaaaatcctcgaaagatgtgtaaagaatactttattaagtgaaaagagtcgctctttgtgtacaagtaagataaatcgcaatagagcttccggagatatcataggtattgatttaggtacgactaatagttgtgtagctataatggaaggtaaacaaggaaaggttattgaaaattcagaaggatttagaaccaccccatctgttgttgcctttacaaatgataatcaaaggttagttggtatagttgcaaaaaggcaagctataacaaatcctgagaatacagtatatgcaacaaagagatttataggtagaaaatatgatgaagatgctactaaaaaagagcaaaaaaatctaccatataaaattgttagagcatcaaatggagatgcttggattgaagcacagggaaagaaatattccccaagtcaaataggtgcatgtgttttagaaaaaatgaaagaaacagctgaaaattatttaggaagaaaagttcatcaagctgtaattacagtaccagcttattttaatgattcacaaagacaagccacaaaagatgctggtaaaattgcaggattagatgttttaagaattattaatgaaccaactgctgccgctttagcatttggattagaaaagagtgatggtaaagttattgctgtatatgatttaggtggtggtacatttgatatttctattttagaaattttaagtggtgtttttgaagtgaaggctacgaacggtaatacatctttaggaggagaagactttgatcaaagaatattagaatatttcatttctgaatttaagaaaaaagaaaatattgatttaaaaaatgacaagttagctttacaaagattaagagaagcagctgaaacagccaaaattgaattatctagtaaaacgcaaacagaaattaacttacctttcattacagctaaccaaacaggtccaaaacatttacaaataaaattaacaagagctaaattagaagaattatgccacgatttattaaaaggaactattgaaccatgtgaaaaatgtatcaaagatgcagacgttaaaaaagaagaaatcaatgaaattatattagttggtggtatgactagaatgccaaaagtaacagacactgttaaacaaattttccaaaataatccatcaaaaggtgtgaatcctgacgaagctgtcgctttaggtgctgctatacaaggaggtgtattaaaaggtgaaattaaagatttacttttattagatgttattccattatctttaggtatagaaaccttaggtggtgttttcacaaaattgattaatagaaacacaactattccaaccaaaaagtctcaaatattttctacagctgctgataatcaaacacaagttagtattaaagtattccaaggagaaagagaaatggctagtgataacaaattattaggttcttttgatttagttggaattccaccagcaccaagaggtgtaccacaaattgaagttacctttgatgttgatgccaatgctattattaacatatcagctattgataaaatgactaacaaaaaacaacaaattactatacaaagtagtggtggtttaagcaaggaagaaattgaaaaaatggttcaagaagctgaattaaacagagaaaaagatcaactcaagaaaaatttaactgattctaaaaatgaagctgaaacacttatttatagttctgaaaaacaattggaagatttcaaagataaaatttccgattctgataaagatgaattaagacaaaaaattacagtattaagagaaaagttgacatctgaagatttagattctattaaagatgccactaagcagttacaagaaaaatcatgggccatatcgcaagaaatgtacaaaaataatgctcaacaaggagcccaacaagaacaaccaaataatgaaaataaagctgaagaaaataaagataatgcataa

SEQ ID NO: 269 - DNA, 1563 bp, Plasmodium falciparum
gataataacgattataagaacgaatcaaagaaaaaactcaaatccattttcataaatgaaaaagaaaaattatttaggagtgtcgataattatttcaaagaattatataatgataattatatgtttttagaaaattgtaaaagtttttcaaatacttcatcagctattttatttttctttaaaacaggaaatatctcctcagaaaatttacattatcaacaaaaaagtggttgggtaatagcagcagatgaaattaataatttaagattaataaccaattttagagctatacacagaggaaccttttttcaagatgttaaagtattaactcccagaaaattattaggagaatcatggggtttcatatgccctgtacatactcctgacggtaccccttgtggtttattaaatcatttggctcaatattgtcatattcataatttatctagtaatgaagcacataaactcaatataaaattgtatcttaaaaaaataggtataaatgtaaatttagatgatactagtggtatacatacaatatatgatgatgaaaacattccaattattgttgattcaatacccattacatatataggtgaaaaagattttaatagaacagtgtataaattgaaatatgcaaaaaacaataatttgtttaatttaaaatcatattttgaaataaatgcttatttaaatgaaccgttaattatgaacagtataataattaatacatttccaggaagacttatacgacctttattgaatttgaaaacgaaagatattgaatttatttcaccatcctatcaaccatatatatctgtagctataaacaacgaagatgtaaaaaaaaataatttagctagaaaacttttaaaaaaaaaagaacaagttgttaattcgatgaaaatagatagaacccctggaagtataaagcagaaatttttatatcatcaaaatagggaaaacttattatggaaattaaaaaaggaatcaaaagatggctcatataaatatgaaaaacataaaattgatagaaaattattaaaaattttagatcagaaaaaaaataacgattcagatacaaatacagataattatgttagtagttctgaatatgatacagattcggattatgattatggttatgattctaattctgatggtgattcaaaatctaactctaattttgattcaaaatctgataatatatcaggaagtgataataatatgtcaacaactacatatattgatagtgatgaaaatattaatattgatatgtatgaacaaataccacaaaaatttgaatatatggaactaaaagagacatcgtttttatcctttcttgcttctttgactcctttttcagatcataatcaaagtccgcgtaatatttatcagtgccaaatgttgaaacaaactatgggaatacaaagtttaaataatgtatatacattcacaaataaaatatatcgaatgataactcctcagtttccattagttgtaacaagagattatgaattttatggagtagataattttcctagtggtacgaatgccgtagtg

SEQ ID NO: 270 - DNA, 1557 bp, Plasmodium falciparum
gattatgaattttatggagtagataattttcctagtggtacgaatgccgtagtggctatattagcttatacaggatacgatatggaagatgcattaataataaataaagctagtgcagatagaggtatatttcgaacacatatatataaaactgaatttattgatttacaaaaagttggagaatctagtaattttgtgtttggaaataatataagatatttaaataataataaaaataataataagaatttggcttacgaaaataaaggaaaatttttaaataaagatggtttaccttgtgtacaacaaaaaataacagagggtagtccattatattcatatattaataaaggtaatgaattaactacttatgaatcttttaggaaccatggagaatatttcgtagactttgtaagtataggaaaaaataattcaaatcaagtagcagttgttaaattaagatcaacaagacaaccacaagttggtgataaatttgcatctagacatggacaaaagggggttgtttctcgattatttcctcaagaagatatgccatttgctgaaagtggaatcgttcctgatattattttcaatcctcatggtattccatctcgtatgactataggtatgcttatcgagagtatttgtggaaaggctgcatctttatatggaaaaagaatagatgctactccatttagaaaatatacgcaacaaaaaagttttaacaatccatggattgacaattgtggtatcaaaggtttcttggaaaaaaatgatacaataaaatctgacttggatacatgtcagaaggaaaaagataaaaataaaaatattaataataataataataataaaataaaagaaaataaatataataactcaaatgatagtaatgcatctattgatagtgatgataatactaacaattgtaatgataaacgtgatgaagaagaaaaaaaagctaatataacttatgatgaaaaaattgattatttcgctaaattgttattaaacaaaggatatgattattatggcactgaattgttatatagtggtatatatggggttccattacaggcacatatatttattggtgtaatttattatcaaaggttaaggcacatggcttatgataaagctcaagtcagaagaacaggaccagtgtgtaacttaactcaccaacccttgaaaggaaaaagaaaacatggtggtataagagttggagaaatggaaagagacggtataatatcacatggttgtagttttgtaatcaatgaaagatttttaatgagttctgatggacatgaatgttttgtttgtcctaaatgtggacttattttatcaccaattatgcaatttaatacaactggaaaaataatgaaaggaagatctattggtggaaaaagtaaaatggctgtatgcaaatcttgtgatgtttcttgtaaaattatttttattccgtatgttatacgatatttattaaatgaactcatttgtttaaatgttaccataaggttgaatatgaaatcagtggaaaatgtttttgacatgaagtaa

SEQ ID NO: 271 - DNA, 330 bp, Plasmodium falciparum
ggacgagggaaaaaagttaccttaatacatattattgattttggtttagcaaaaaaatatagagattcaagatcacatactcatattccatataaagaagggaaaaatttaacaggaacagcaagatatgcaagtataaatacacacttaggaattgaacaatctcgtagggatgatattgaagcccttggatatgttctcatgtattttctaagaggaagtttaccatggcaaggtctaaaggctatatctaagaaggataaatatgataaaattatggaaaaaaaaatatcaacatcagtggaagttttgtgtagaaatgcaagcttc

SEQ ID NO: 272 - DNA, 1287 bp, Plasmodium falciparum
agtgtggcctccattagcagaaattttgaaatttctccgttctcaaattatggacacaagagtgtgcacattttagccccaggtcatcacatatattctactattccaaataactcatacaagatctttacaggtacttctatggctgctcctcatgtatgtggtgtgagtgctttggtatattccgtttgttataaccaaggttttattcctcaagcggaagaggtgttagatatattaacaaggacatctataaaaataatttctacaaagaaaagaaccataaatgacagtttagttaatgcagaaggagcagttttgactactttattaggaggactatggatgcaaatggattgttattttgttaaatttaatttagaaaaaggcaagaaaaagcatattcctgttgttttctcggcttacaagaaaggagtatatgaaacagatatcgttatagctattatacctattgatgggaaatccaaaatatatggagaaattcatattcctataaaaattgtaaccgatgtaaatattcccaatttccaagaatctccacgaagaggaaaaaattatactatagattctaatgaagcacaacatgatgaagtcctttcttatatctgtgaaaatgccttatataatttgtatgaatatgatagtcattatttgttggcttctgtcatattattttttctagcattattatccatatttgttggaatgatatatatgaagtcgcgtaaacatagtgataagaaatgttctaaaaatcttatcaaaagtaattatataccagaaatggatgatggtatggaagaaacacaacaactgcaacaagaaagaagacaatatttcagagaattatttggagaaaatttggaaaagaattacgatcagcattttgtacaagattttggtcaagattttagacaagatttcaagctgggttcaacaccagacttaaaacaatattctgatatagatttacaaaataagatacagcaaccggaaaggaaaaccgtaaagataattattaataactttgaagatagaaagaaagagaccaaaagaagactactcaagggattaaattatgatggagaaaatgcaaagaaacatgatttcacgaatgaaagtattagcaatagtaggaaaaattttaaattctcaaacaatacagaaatgaaaaaaaatactataaaaagtgaggacgtcaaaatagcatctgacgataatgttaataaagcaatgaatcaacttgatgatatgtttatgaaatga

SEQ ID NO: 273 - DNA, 2814 bp, Plasmodium falciparum
ggtattcacagtggcatgactttgtacaatattcacaggtgtatttgtatatgcttaggagtaaaaaaagaagataccgacaattatttacatgtatttattctaaataatggaaatatatacgggagtgggaaaaaatgtagtgttagtattataagaaaaatacaaataaataccgatcgacacattacattcaagcatataatcaagacacctttgtatctatataaatcaaaagaagataaaaacaaaaacaatagtaataataataataataataataatagtaataataataataatagtaataataataataatagtaatagtaatagtaatagtaataataatactaatagtaatagcaatagtaatagtaatagtaataataataccaatagcaataataatagtaatagtaatagcaataataataatagtaataataatactactactaataatagtagtagtagtaataatagtaataataataattattatcataataattataaaaatgaaaaagaattgaataattcttcctctcttgagcattccagtattattatgaataatgataatatacataataatataaataacaaccatattaataatattacagatttaaataatatgaacgtaaatcaaagcaacatgaaagaaaataataatataattgattatatgaacaataataataataatgataattacagtaataaccatttgaataattgcataaacaaattatatacaaataatatttattttactgaggattctcaaaaaaggaaccctctacaaacatataatacttcaaaaaatacgaataactttttgaatgtaaataattttacaagttcatataatttccctaatataaataatatggacagtaatatatataaccatacaacatgtaataattttaacaaaaatataaataataacattaatgatatatccattaataaacataacaatatatttaataatatgaatcatttaaatcatttagataaccattcttatattcaaaataatttatataaaaatcatatgaatgtaaatacaaacattctatataataatcctatcatgaataatattaacaatgatcaaataaataatttatctataccaaataataaaaatgaggataataatgaaatcaatcatgatgatagtaatgatgatgacagtaatagtagtcatataacattaaataaaagcgataaaaataaaaactattttgcgttaaatccaaaatatcaaaatcatcaaaatcataatataaacaataatatccaaaataatctaaacgaacaaataaaagaaaaaaatgatcaacaaaatcataatattaaagaaattaaaaataaagaattattaaatgataccatttcttctattgaagacactaatgataattcatattccaagtatattacttcttctgatatatcacaaaataatacacttaattcttttcaacataataaggagatttccgtaaattttatgtacaacaatataatacttgataacaataataacatcaatgatgacaataataataataataattatttttgtattccatgtggatacaatacaaaagaatataaatataatatatataatacatacaattatccaaataatgctaaccatatatacaataatatgaacatttcatataataacagtgcctacaacaataattatgttacatataataattttcataattcttaccataataattacattctacataataattttcataatccttacaatatatatgataacattcaaaatacagaacaaaaaaaattatataatatatatcaaaatgatgaaagacaaaacaattcatttaatcatattaatacagatcctcataaagttgtaaattcaaataattttctgcctattaatacatttcattataacaacaacttaaatcataacatattaacagaatcaaataatttaaatagaaaaaatgaaaatgataatattccttctagttattcacaaattcataatcatcaaatatgtaaaaaagtagaggaatatacctacaattctataaaccaaaacaccaataattttaataataatgtcatgatgttaatgaatacatcaaataacatccccctggataataatacttataattctaataaaaacaaaataatatataaacatattatcaatgatcatatcaatcaaaaggataataatgtggaatatgaaaatttaaataattcttgtgataatacacaaaataaggaaaccttttgtaatcaagatcttataaatagttctaatataaataataatataagttcctacacatttcaaaataataatgatttctatacaaaaaaaaaaagtatgcaatataatcatgataacatttacaaaataaatactacttcagaaaatgtaggaagcccacacaccaacaataaaacaagcatatataaccacaaaaaagggggatacgaacagcacacagagcagaacaatgaacagaacaatgaacagaacagtgaacagaacatcgaacagaacatcgaacagaatattgaacaaaatgttgcacaaaatgttgcacaaaatgttgcacaaaatgtcgaacaaaatgtcgaacaaaatgttgcacaaaatgtcgaacaaaatgttgaacaaaatgtcgaacaaaaggccgaacaaaatagtaataatgaatcaataaaaaccaatactgtagaaacatttaaaagaaataaaaaccagattaccaactcaaataat

SEQ ID NO: 274 - DNA, 2802 bp, Plasmodium falciparum
gttactgaagaaatagtagaggaagaaggctctcctaatgaagaaattgtagaaggagtatcagttattgaagaagatgataatatagaaccagttagtgaagaaatagtagagggatcggttactgaagaaatgataaaagaaggtttagaaaatgaagtaatattagatgaagattcaattactgaagaggctttagagaaagaaggatcagttagtgaagaaatagtagaggaaatgggatcacttactgaggaaatagtagacgaagaaagatcaacttccgaagatatgatagaagaaggatcagcttctgaagaaataatacaagaagaatcgcaagttgaagaagttgtagaagaagtatcagttatcgatgaaatagtagaggaagacgaattagatactaaagaagttgtagaagaaatagaatttaatactgaagaggttgtagaacataaagaagaagaaggatctgtcgctgaagaaatagtacaggaagaaaaggaaggatctgttaatgaagaaattatagaagaagtaggctcaattactgaagaaatggtagaacaagatgtatctgataatgaagaaatagtagaagaaagatccgttattgaagaagctgaagaaaatgtatggattgagaaagaagtagaagaagaaggattagataatgaagaagtcatagatgaagaagattcagttagtgaacaagctgaggaagaggtatatattaatgaagaaatattaaaagaatcatcagatgttgaagatgttaaagtagaaaacgaattaatgaatgaagaagttaacgaagaaacacaatcggttgctgagaacaatgaagaggataaagaattagataattatgtagttgaagagactgaatcagttactgaagaagttgtagtagacgaagtaccaaactctaaggaagttcaagaaatagaatcaattatagaagaaatagtagaagacggattaactactgatgatttagtaggacaacaaggatctgttattgaagaagttgtagaagaagttggatcagattctgaagaaatagtagaggaagcatcaattactgaagaagtcgaaaaaaaagaatcagttacagaggatattttagtagaagaatcagttactggggatattttagtagaaggatccgtaactgaagaagttgtaggagaagaaaaattagttagtgaagaaatagtaacggaagaaggatctgttgctcaagaaatagtagaagaagatgcaccagctactgaagaaattgatgaaatagaatcagttactgaagaagttgtcgaagaagaaggacctgttgatgaagaaattgtacaagaagaaggatcagttactgaagaaataatacaaggagaatctaaagttgaagaggtcgtagaagaacaaggatctgaaaatgaagaaatattcgtagaagaagtatcagcttctcaagaaatagtacaaaatgaatcaggtaccgaagaaatattggaaaaagtatcagcttctcaagaaatagtacaagatggatcagttactgaacaaataatagaggaacaaaaaccagttactgaagaggttgtaaatgaagaagaatcaattactcatgaaataatacaggaagaatctcatgttgaaaaagttgtacaacaaggatcagttgctgaagaagttgtagaaaatccagtatctgttactgaagaaatagtagaaaaagaaggatccgttactgaagatataggacaagaaggttatgttgcggaggaaattgtagaagaagaagaatttgataatgaagaaattttagaagaagaatctgttgctgaagaatttgtagaagaaggatttgataatgaagaaatattcgtagaacaaatatcagattctgaaatagtaaaagaagaaaattcagttaatgaagaagtcttagaagaagaaggatcatatactgaagaaatattagaagaagaaggatcatatactgaagaaatattagaagaagaaggatcatttactgaagaaatattagaggaagaaggatcatataatgaagaaatattagaggaagaaggatcatataatgaagaaatattagaggaagaaggatcatataatgaagaaatattagaggaagaaggatcatataatgaagaaatattagaggaagaaggatcagctactgattattttgtaggacaaggatctgataatgaagaaataatagaagaaggatcagctactgattattttgtaggacaaggatctgataatgaagaaataatagaagaaggatcagctactgattattttgtaggacaaggatctattattgaagaagttctagaagaagaaggattagatactgaaaaagtttttgaaaatgaaggatcggctactgaatttgaggaaacagaatcgtttactgaggtagttgaagagacagaatcagttaatgaaaatatcttagaagaaacatcaattaacgaagttcagaaaatcgaatcaattactgaagatattaaagaacaattagttcctgaagaaattaaagaagaacaattagattctgaagaaattaaagaagaacaattagattctgaagaaattaaagaagaacaattagttcctgaagaaattaaagaagaacaattagattctgaagaaattaaagaagaacaattagattctgaagaaattaaagaagaacaattagattctgaagaaattaaagaagaacaattagattctgaagaaattaaagaagaacaattagttcctgaa

SEQ ID NO: 275 - DNA, 1569 bp, Plasmodium falciparum
ggaaattttggatataatggaagttcaaattctggtgcacaatttactgacaggtgctcaagaaatttatactgtgaaacattgccaatcaacccatatgctgattctgaaaacccaatagttgtaagtcaggtatttggtttaccttccgaaaaacctacgtttacgttagaaggtactcctgatattgatcatacaaatattttgggttttaatgagaagttgatgactgatgtaaatagatatcgatattctaataactatgaagccattccccatacaagggagttcaatccacttattgtagataaagttcttttcgactataacgaaaaggttgataacttaggaaggagtggaggagacattataaaaaaaatgcaaactttatgggatgaaataatggatattaataaaagaaaatatgattttttaaaaacaaaattacagaaaacttacagtcagtacaaggttcaatatgatatgccaaaagaagtatacgagagcaaatggggacaatgcttaaagcttattaatcaaggaggtgataaccttgaagaaagattgaacacacaatttaaaaactggtacagacagaaatatttaaatcttgaagaatatagaagattgactgtgttgaaccaaatcgcttggaaagctttatccaaccaaattcaatatacatgcagaaaaattatgaatagtaacatttcttcttttaaacatataagtgaattgaaaagtttagaacagagagcggcaaaagatgcacaagaagaaatgaggaaaagagctgaaaaacagaagaagaaaaaaagtaaaagaagaggatggttatgttgtggtgggggagataacgaaacagttgaaccacaacaagaagaaccagtccaagacgttggagaacatcaaataaatgaatatggtgatatattaccatctttaaaagttagtattaataattcagcaattaattattatgatgcagtaaaggatggtaaatatttggacgatgattcatcagatgctctttatacagatgaagatttgttgtttgatttggaaaagcagaaatatatggatatgttagatggatctgaagacgaatctgttgaagacaatgaagaagaacactctggtgaagcaaatgaggaagaactaagtgttgatgaaaatgtagaagaacaaaatgttgatgaaagtggagaacaacaaagtgatgatgaaagtggagaacatcaaagtgttaatgaaattgtagaagaacaaagtgttaatgaaattgtagaagaacaaaccgttgatgaaattgtagaacaagaaaccgttgatgaaaatgtagaagaacaagctgtcgatgaaaatgaagaacaacaaaccgttgatgaaaatgtagaacaacaaactatagatgaaagtcaagtacaagaagaaatatctactattcaagaaaatatagaagaggtagttagtgaagttcaacaagattcagaggtagatagaactcttcatgttcctgatacaagattctatgatatattaggtgttggagttaatgcagatatgaag

SEQ ID NO: 276 - DNA, 798 bp, Plasmodium falciparum
tataattttacatatagtggaaattcaacttgtagattacaatttactcatagatgctcaagaaatttatatgggaaagaattatcaataaagccatacttgaactctcgatatccaatagttataagtcaagtctacggtttaccctccgaaaaacctacttttaacttagaatgtatccctgatattcattatacaaatattgtgggatttaatgaaaaattgatgaatgatgcaaatagatatacacttttaaataactatgaagtaattcctcatgtaaaagaattcaaaccacttatcgtagatgatgaactacttgaatacaaccaaaaggttcataacataggaagaaatggagaagacattttaactgctatgcaaacattatggaatgaaataatggatattaataaaaaaaaatatactgtgttaaaagcaaaattacgcaaaaaataccataaatacaagattcaatgtgatatgccagaaaaagcttacgtttataaatggagacaatgcttaaatattattaggaaaggaggacataatcttgaacaaagattgaacaaacaatttgatacttggtacaaacaaaacgcattatatcttgaagaatatagaaggttgactgtcctgaatcaaatagtttggaaagcactatcaaaccaaattgaatattcctgtagaaaaatcatgaccagtgatattacttcatttatacgtataaatgaattagaaattatggaacagagagcagaaaaagctgctcaagaagaaatggagaaaagggaacat

SEQ ID NO: 277 - DNA, 2985 bp, Plasmodium falciparum
atggggaatacacaatcatcagaggaagaggaagctaaaagccctagtttaacagaaagtcacaacagtgcaaggggtgttttggaagaaattggaaaaaagataaaagataagacagaaaaagagagtaaacatgtaaggcaattgaaaggaaaattatcaaatgcaaaatttgctgatcgattgtataaggaatctggtggtgatttaaggtctgcttattcagatgcttgttcacttacatacaaatttcatactaatataacaactgatgggggggatggaaggcatccttgtcatggtagggaaaacaatcgtttttctgaaagtcaagaatatggatgtagtaatgtatacataaaaggaaatgaaaataacagtaatggtacagcatgtgtaccaccaagaagaagacatatatgtgatcaaaatttagaatttttagataatcctcacactgatgatactgatgatttgttgggaaatgtgttagttacagcaaaatacgaaggtaattatattgttagtaatcatccagataaaaacagcaatggaaataaatcaggaatatgtacttctcttgcacgcagttttgcagatataggagatattgtaagaggaagagatatgtttaaatctaatgaaaaggtagaaatcggtctaaaaaaggttttcgagaaaataaataatggattgaagaaaataggaattaatgattataatgatatatctggaaattattataaattaagggaagcttggtggacggctaaccgcgatcaagtatggaaagccataacatgtagagccccaaacggggctaattattttagaaaaggtttagatggaaaaataattttttcagataatggaccatgtggtcgtaaggaactaatcgttcctacctatttagattatgtccctcaatttttaagatggttaaatgaatggtcggaagagttttgtcgaataaaaaatataaaaataggaaatattaagaaatcctgtactggagaaagtaataataaacattgtagtcgtgagggttacgattgtaataaaacaaatctaagacttaatgaaatttttatggatctagaatgtccacgttgtgcagatgattgtaaatcgtatgaaacatgggtagaaaaaaaaaaaaaagaatttaataaacaaaagaaaaaatacgaaaaagaagttgatgctacacaaaataatgataataacgaaaatggaatctataataaaaaattttatgatgaactaaaaagttcatataaagaagttaatagtttttttgaattattgaataaaggaccaatatgtgaacatattgataaaaaaattccaatggactataataatactgagaaaacattttcccgttcagagtattgtaaatcatgtcctataacagatattttatgtgatgataatgaatgtaaaaccattaatgaatttaaatgtagagaaataaaaagtatgcctaatataagaaaaaacgaaaatgaaacccctattgatattgatattctggttaatgttaataacaaaaaggttattacgcatgatttaaagaataattacgaaaactgtgatctttttaaaaaactaggagaacaaaaatggaaatgtaaatataaatgttacttagatgtatgtgaaccgagaaatttggatagtaatatatataatgaacgatatatctcaattaaagtactatttaaacggtggttagaatatttcttagaagattacaataaattaaaggaaaaattgaacccatgcatgtataatgtacaagaaatcgtatgtataaatgaatgtaagcaaaattgtgaatgcgtagaaaaatggataaaagaaaaaagggaagaatggaaaaaaataaaagatcgttacgtacaacaatatgaaagtaaagatgaagatgtttcttctaaacttaaaaaatttttgaaacaggaactgtttactaattatgttaaaaatgccttggacaaggatgaaacgttagatagtatgaaagaatctactgaatgcattgatcctaataaacccaaaggaaaaccatgtaacaataacgatgtcataaatattttacttaatagacttgaaaaacaaatcgataattgcaaaaagaagcacgaagaaaagggagaaaaaccttgtgttgatatacctaaacttctaaatgatgaagatgaggacgaagatgacgacgaaacaccacgcgcccataatccgtgtgtagataaaaatgattctcaacccactaaaactgtgagttatatcgctagacaaatgcatcgaagggcaaaagcacaaatgacaaaaaatagtgttgttgatggtgataataagttggaaggcgatatatttaaggttacatttagaaatggcggggtcggaaaaaacctgaatggagatatttgcaagattgacaaaacgtattccaatgacagtcgtggtactcctacagatggaccttgtgaaggcaaaggcgatcggtttaaaataggaacggactggcaaggtgatagtttcgtaaacccacaataccgtgggatttatatgcctcctagacgtcaacatttttgtacatcgaatttagaaaaattagatgttagtagagtcataagaaatggtaatgctagcaattcattattgggtgatgtgctgctcgcagcaaagtatgaagcagaacgaacaaagaaccattatgtatctaaaaaggaagaacattccgaagcttgtcgtgctgtgcgttacagttttgccgatttaggagatattatacgaggaaaagacatgtgggataaaaatcatggcgagaagaaaacacaagaaaatttagaaagaatatttgctaaaattaaagagcaacttcttaatagcagtatcaaagataaatataaggatgatgacaaagcaacacccaaatataaacaattaagagaagattggtgggaagccaatcgttca

SEQ ID NO: 278 - DNA, 2985 bp, Plasmodium falciparum
gcaacacccaaatataaacaattaagagaagattggtgggaagccaatcgttcacaggtatgggaagcaatgcaatgcccaccaaaaaacggtactttcccatgtaaaagtgatcatacaccgctacatgactacatcccccaaagattaagatggatgaccgaatgggcagaatggtactgtaaagaacagtcacggctgtatggagagttggtggagacgtgtggtaagtgtatgcataagggaaaatgtaagcaaggtaatggccattgtgtaacgtgcaagccagcatgtgaaaaatataaaaaatttattaatacatggcaacctcaatggaaacaaatggaacaaaaatactcccagttatacgaagaagcaaaaaagtataatgatagtagcagaaaagataccacaaacaaagacgattatgtccttcaattcttgaacaaattactcacgcaaaacaaaggaaataaaacatatgatactgctgaaggatatgtacaccaagaagcacatattagtgattgtcagaaacaaacacaattttgtaaaaaaagaaatggtgagatcccaagtagtgatacagagaccgacaacaattatgcctttcgtcctcaaccacacgaccatgatgaggtgtgtgagtgtaatactagacagaagacgaaggtacggaaaaaaaaaaaaaaagttgatgcatgtgaaatggcaaaaacacttttgcacaacaacgatggaaccataagaataggacaatgcaaacgtaaagatgaaggaaatgcagaatatccaaaatgggattgtaattctcagattcatacaacacataatggagcatgtatgcctcctagaagacaaaaattatgcgtatatttttttgcaaatccatctcaaataggaagtataaataaacaagataatttaagaaaagcatttattatatctgcagcagcagaaacatttcgttcatggcagtattataagagtaagaatggtggtgaaaacctccaaactcaattaaaagatggaactattcctgacgattttaaacgtcaaatgttctatacatatggagattatagagattttttatttggaaccgatatatcaaaaggtcttggtgaagggactgccctagaaaagcaaataaatattcttttcccaaatggtgtccgaaaaattcctaatgaaaaaacacgtgaaaagtggtggacagatcacggacctgagatatggaaaggtatgttatgcgccctaacaaatggtctcagtgaaagcgaaaaaaaaacaaaaatattcgacgactactcacacgacaaagtcaaccaatccaaaaatggtaacccttccctcgaggatttcgcaaaaaaacctcaatttttcagatggtttattgaatggagtgatgaattttgtcgggaaaggaagaagaaggaagaggaggtggaaagggattgtaaggatgaatatgagggatgtgaaaaggagaaaaatggtaaatgtgttaccgcatgtaaagcatataaagaatacattacaaacaaaaaagaagaatatgatagtcaaaaagggaaatttgacgttgaaaaaacagagaagaaacaaggatatgaagattattctgagaaacaggcttctgaatatttgaaagaaaaatgtataaaatcatcatgtaattgtatgaagaaagttacagaaatttccaattactggaccaaccctcataaaacctacgacaccgaaaatcttggaatcaaatgtgaatgccccccttcaccctgcaccatcgtggatggcatcctcagcccacaaaattcgagttcgtacgccgaagggtgtaaatggaaatatgggaagatgtcacaagggggtacggaatgggattgtagtaaaaaaagtgggggtgaaggtggtaatgaggacggtgatgttgtatgtatacctccaaggagaaggagattatatgtaaagaatttacaggatttgactggtgaagaatcactagtggatttacgaaaagcttttattaagtgtgctgctatagaaacattttttgcttggcatgaatttaaaaaagaaaaagaaagagaggaaaaagaaaaaaatgaacaagatgtacaatataaatcatctgtcttagaaaatcttcaaaagcagttaaaaaatggagaaatagatgatgagtttaaaagacaaatgttctatacatttgcagattatagagatatatgtttagggaaggatataggtaacgacgtggatggaattaatgaaaaaatagatacaattttgcaaaaaaatggaaaacctaataatatcgaagaatataaaaaatggtggcaaaaacatggtcatgagatatgggaaggaatgttatgtgctctaagctacaataccgaaacaaaagagatggataaagaacttcgcaacaaattaaccgaacaaaagaacggtaacaaaaacacgtacgacaccgtcacaattagtggtggtcccattggtaataccaaattggagaaatttgcatctaggcccccattttttcgttggttagaagaatgggcagatgagttttgtagaaaacgaacacataaattggaaaaaattcaaaatgaatgtaagggagtaagtggtacaaatcagtgtgatgatgatggttttgactgcgatgaaatgtgtccaaaaaaggatgggagttttgaaacgtttaaatgtctgagttgtgccaaatcttgtagattttataaaaagtggataagtagaaaaaaagaggaatttgataaacaaagcaaaaaatacgaaaacgaaattgacgatgttaaacataattctgataacatatatggaaaagactttcttgaaactcttgatcaacaatataagtctgttgaattatttttagaaaaagtaaaaggaccatgttctattaataataataatgaagaatgtaaaatagattttaataaaccaaaggatacattt

SEQ ID NO: 279 - DNA, 1197 bp, Plasmodium falciparum
aaaaaaccgaaatcacctgttgacctcatacgtgtaattgatatccataaaggcgattatggaatacctacattggaatccaaaaatagatatatcccctatgtgagtgatacatacaaaggcaaaacatatatatatatggaaggagatactagtggagatgaaaaatatggatttatgtctgatactactgatataacttcctccgaaagtgagtatgaagaattggatattaatgatatatatgtaccaggtagtcctaaatataaaacattgatagaagtagtattggaaccatcaaaaagtaatggtaacacactaggtgatgatatggtacctaccacgaatacatttacagatgaggaatggaatgaattgaaacacgattttatatcacaatatatacaaagtgaaccactgaatgtaccacaatatgatgtattaaaggagttaccaatgaatatagtaggtaatgttttagatgatggtataaacgaaaaaccttttattacttctattcatgatagggatttaaatagtggagaagaaattagttataatattaatatgagtactaatagtatggatgatccaaaatatgtatcaaataatgtatattctggtatagatttaattaatgattcactaagtggtggtaaacctattgatatatatgatgaagtgctaaaaagaaaagaaaatgaattatttggaacaaattataagaaaaatacatcaaataacaatgtagctaaattaacaaatagtgatccaattatgaaccaattagatttgttacataaatggttagatagacatagagatatgtgtgagatgtggaataataaagaggaagtattagataaattaaaagaacaatggaataaagataatgatggtggtgatatatcaagtgatagtaacaaaaggttgaatacggatgtttcgattgaaatagatatggatgatcctaaaggaaagaaggaatttagtaatatggatactatcttggataatatagaagatgatatatattatgatgtaaatgatgaaaacccatctgtgaatgatatacctatggatcataataaagtagatgtacctaagaaagtacatgttgaaatgaaaatccttaataatacatccactggatccttggaacaacaatttcctatatcggatgtatggaatatataa

SEQ ID NO: 280 - DNA, 690 bp, Plasmodium falciparum
atgaaggtctctaaattagtcttgtttgcgcacatattttttattataaatatcttatgtcaatatatttgtttaaatgcttctaaagtaaataaaaagggtaaaatagcagaagaaaagaaaagaaaaaatattaaaaacattgataaagcaatagaagaacacaacaaaaggaagaaactaatttattattcattgatagcatctggggcaatagcatcggttgcggcaatattgggattaggatattatggatataaaaaatcgcgagaagatgatttatattataataaatatttggaatatagaaatggagaatacaatataaaatatcaagatggtgctatagcaagtactagtgaattttatatagaacctgaaggaataaataaaataaatttaaataaacccataattgaaaataaaaataatgtagatgtgtcaattaaaagatataataattttgtagatatagcacgacttagtatacaaaaacattttgaacatttatcaaatgatcaaaaagattctcatgtaaataacatggaatatatgcaaaaatttgttcaaggattacaagaaaatagaaatatatctctatccaaatatcaagaaaataaagctgttatggatttaaaatatcatttacaaaaagtttatgctaattatttatctcaagaagagaactaa

SEQ ID NO: 281 - DNA, 420 bp, Plasmodium falciparum
atggatgctgttcaaaagagagtattgaaaagtaacccaagcgatttagaaaaagaaatagcacaatgtttgttagacattgaattatctagttcttcggatataaaaacagatgctaaagaaataaaattattatcatgtgatttaatagaagtagaaaaattaaaaaagaaaaccattttaatttatattccttacaaaatttatacaacctatgtaagaaaaatccaaagaaaattaattaatgaattagaaaaaaaaacgaaaaaatatgttgtgttagttgcaaaaagaacaatattaaaaggaaaacaaaaaaataaatctttcaaaattatcccaagatcaagaactttaaccagtgtatatgattcaatccttgaagatattgtatcaccaagtgaaattattggaaagaga

SEQ ID NO: 282 - DNA, 2553 bp, Plasmodium falciparum
tacatttttgccgattcatataaaagtctgcaagtggacaaaagggatattttcatgactataataactgttattagatattactacctcaatatatattttagtataaaagaatttaaacttaataggaaaaatattttctattttcaaatatttcaggaaaatcaaatgaagggtgtttatttgagtgtccgtgataagaaaagggttgaaaatattaaaaaatggtatttaaacagcatgaaaaaaataaatcacgacgaaatactagaaagtttaaaaaattcatccataaatataaataataaaaactttatgatatgtaccaatcatgagcaagatacagaagaaaaaggaaatacacaaaataaggagaagcatgatatttatattggaccaatatataataattcgttcgacagtacaacaacaacacatagtagtaataattataaagggaataatatccatgtgagtggggattataagaatgatgggctattacataaaggtaataatagtatgaatgaatgttatgtgaaggacataaaatgtaataataataataataataataataataacaacaacaataatattaataatagttataataaattaaattgtgttacgaataatagcaaaaatgacataattaaataccacaaaactatcgacacagataatagtaaaaatcatacatactttaaaaataaattcctaaattttttggataaaaaaattattagtaatatatatggcttaccacaaggttttagcttatctaatatattgtgctccctatattatgcatatttagataaaaatgaagaatttcaaaatttattatattcagaaaaacaaatcaataataaatatttcttagcaaatggaacttgtaattatttcaatttaaattcactcatactccgatttattgatgactttttatttataactcttaataaaaaaaatattaaaatatttaaaaacttactattaaaaaaaaaaatatggggaagtaatattaattcatccaaaaccaaaatcttcaaaataccacttatatataaaaatgatttactaatatataattttcaaaataaataccaacaaaaaaaaaaatacaaaataaaaaataaaaaaaaaatacaaagtgtgaggaacaaacggatacataatcagctagtcaatgctaataaaaaaaaacacacatctgtacaaaaagataaaataaataaatatataaatctcatacatccaacaatacaaaaaaatgattctgtcttgtcttctaattctattatgaattttgaaaggatatataataaagaaagtcataaaagtaacagttcaatacgtacggatattccgaatagtgttgtaaatgacgatatagaatataatcaaaaaagtgataataattcttacagtactaataatttatacaacaatataaatatgactcaaaatggtgataataataatgttaatatttttaaacatgtacaaaatgattcttttcaatgttttaatagtaacaacttatatattgaaaaggatataaaagaaaataatatttcacaaatcaacagaaagttatgttctaaaagaaattttacaaaaaaaagtagaaaaataaatactttgacatatttacaaattgataaagttataaaaatcctaaaatgtaagaagaaatatataaaacatataaaaaagatgaagtatatgaataattttcaaaattttaaaaaattaaaaaaattacaaaaatttcataatgcctcttttgaattaaaaattaataaaattaataaaaatattagacgattgaataaattaaaaaaacgtaaaaatcattctataaacattactcctgttacttctatagaatggttaaataattcatacacatttgattttataaataattctatacaaagcacttcatatccatggaaaaataaatgtgatgctactattagaaatcatttacatctacataatgttattatagataaaaataataaaacttattttatgaaaaacctagttgaaaatagaattgtacgaaatattatatccaaacaaaaaaaatgtcaatccttatataagaataagcaaaatgtatatttctgttataaaaataattttagcttattaaaatcatctatattaaaattcatctgttgtattaaaacactcaaaaaaatgtttaatgcatttacaaattctacatataacacaaaatttatattatttctcatatcgtatatgaataaaatgttaataaaaaataaaaaactcaaatttgtcaaattgtttttaattcaaacagcaatcgaagccttccgttatgccagaatttttaatcagcaggattccttttatccgtgtctccaacatttcaggaaaatcaaaaaaagattaattaacaaatacaaaattggacataacaaaaatttattgcgagaattttttttcctgtttaattttatcaagaaagagttgtataattcatggccttacatgttcaaaataaaaaattaa

SEQ ID NO: 283 - DNA, 1131 bp, Plasmodium falciparum
gaaaccattaaagtacctagacttggtgattcaatcacagaaggtacaataaatgaatggaaaaaaaaagtgggagattatgttaaggcggatgaaacgataacaattatcgatacagataaagttagtgttgatataaattctaaagtaagtggagggttatccaaaatttttgcggatgtaggagatgttgttttggtagatgcacctttatgtgaaattgatacatctgtagaaccacctgaagatatttgtaaaactaaagaggaagtaggagaaagtaaaaataatgaaaataattatacatttaatcaattaaatagagatattaaagatgaagcacatataaaagatgaagttagtaaaaatgaaaaagatatttttgtaaaagatcctatatgttttggaaatgattatgaatcaataaatgaaagaacagaaagaagagtccgtatgttacctataagaaaaagaattgcagaacgattaaaggaatcacaaaatacatgtgctttattaacaacatttaatgaatgtgatatgtcaaaggcaatgttattaagaagtgaattaaatgatatatttcaaaaaaaatattcatgtaaattaggatttgtatcattatttatgtatgcatcaacattggctttaaaaaaaatgccaaatgtaaatgcatatatagaaaatgatgaaattgtatataaaaattatatagatatatctgtagcagtagctacaccaaatggcttaaccgttccagttataagaaattgtcaaaataaaaatttaccacaattagaattagctttatctgatttagctacaaaagcacgatcaaataaattatcgattgatgattttagtggtggtacatttacaatatctaatggaggtgtttttggtagtatgttaagtactcctattattaatatgccacagtcagctattctaggaatgcatacaataaaaaatagaccagtagttgtcaataatgaaattgttattagaccaattatgtaccttgcccttacatatgatcatagattattagacggaagagaagccgtacaatttttatgtgcaataagagattatatagaaaaccctaatctaatgttaattgattgttaa

SEQ ID NO: 284 - DNA, 1218 bp, Plasmodium falciparum
ggtgtggctagcatgaatgttaccttaggtgttcctagaataaaagaaataatcaacgcatctaacagtattcaaacaccaatattaaacatccctttagaagtgaacgataattataattttgccctaatgatgaaatcaaaattagaaaagacgacaatacgtgatatttgtatgtatataaaagaagattatactagtcgaggtgtatttctatccgttaagtttaacgaagaattaatacagaagctttttctaaatatcaatgcatacaatatcaaagatattatattaaaacaaagtcatattaataaaataaaaattaataaaatacatattaatgtaataaataaatataaattacatatttctttaaaaaatgatgaatttatattttttcaaatggaatccttaaaaaagggtttactagatctcttgatttatggagataaagatattaaaaggtgtatcataaaaaaagaagatattgaagtaacagataatgaagatgaaatatgtgatgacatggatgaatattataatgtttctcaagggacagagttatatgaaagaaaatgtaatagtaaagaagaaaataaaaatgctattcgtgttaagaaagaagaaattgatgataatctcgagaaggaagagaatattatttatgtgtcagaaaaggatagcgttaatcaattgaaaagtgaaaaaaagaaggatattaatgatgataataataataatgatgataataataataatgatgataataataataataatgatgatgataataaaattaatgatactatttttaatgatgacattaacagtgatcgaaacaaccttaaagaaaatggtagcaaattagaaaatgtcggagaacatattatagaaagattaagctacaaaatgaaagaaaaaaatgttaaaaaagagcatataaaaaaagaaccgaaccttataaatttagacactataaatttagatacattaaactttgacgaaataaatgtacataatataaataatgagaaaattgaattttatgatgaacatttaaatatatgtcagggaaacaaaaaacatattcaaaaaaaaaaaaaaaaaaaaactgtatactcaatattagtagaaggaaattcgttgaattatgttcttggtttagaaggtgttgattttaagcatatcatttctaatcatgtcataaacgtttttcaa

SEQ ID NO: 285 - DNA, 1536 bp, Plasmodium falciparum
atggcttcgggaaaaggtaaagaaaatatatcgacaaaagatacacgtaatgatgaggataatacaaataagaaatattttgttgatgttataaaaaggttgaataagaatgataataagaaatattatttggatgaagaaaataaaaccgagatccaggatgcagaaacaaaatttaagaatgaattgaatgaagaaatatataataaagatgattatataatatatgatgatggaaatccagaaattcaattttttacaaataaacaaaaattaaaaatagctagatattcttggaaagcagaaaatcctaaagcatatgtttttgctttacatggtatcacatctcatttgagaaatgaatatttgaattattatggtcgtcctatatgggctcataaaaaggatgaggtacatgataataatatatcgagtgacgataataataatatacctagtgatgataataataatataccgagtggtgataataataatataccgagtggtgataataatagtaataataataataataataatgcgaacaatgattataaacctcgtttagataaatatacaaacgaattgaaagagtcggaaaagaataataatgattatataattaaggataatttaacaaacacaattaattatggatatcataggggtaatgtaggtgaagatattaataacgacatagagaaaacccatgaaagaggtaagagcatagaagtaaagagcgaagtaaatataccaaaatatacatcgacatcatcactaaataaagtaaatggtaacaataatatagaatgtgaaaacttaagaaaaaacagtttaaaaagtagagaatcctattttatgaataatgaacctgagaaatcagtattaaacgaaggagatgtatatgagagtacatcatccttatcatgtagttcatccgaattaatggataagaaaacattggaaaagaaattgactatgtttttatcatgttcttcttgtatgtctaattataacgaaaatacaaatggtttaaataatgataaaaagtttgaaacaggttcagataatgaaatgaatagtgatgataatatgatggttgatgatgataatgttttattaattgatgagaattataatagtagtaatagtaacaataatagtaaaaataatggtagtagtaataatagtaaaaataatagtaaaaataatagtaaaaataatagtaaacatagtagtaaaaataatagtaaaaataataaaaacaataataaaaacattaataatgatagtaataataataataattacgacggatgtaatgataatacagtttattattgttccatgtgtggatctgtttgtaattattgtaattgtggagaacgtactttgtcatataaaaatagttggatagaaaaattaaatgaaaataatttttcttttttcggtatcgacaatcagtcacatgggttatcagaaggatcaagaaatcagcgatgttttgttgaagattttgaacattttatatca

SEQ ID NO: 286 - DNA, 2787 bp, Plasmodium falciparum
atgaatattttgtgcatccatattgtttactgctttatcgcttgtcttttattatgtaatataaatcaggtgtttacacttcatgtattaaattataataacggttacctttataagaatttatctttttccatccctttatataagaatttatttcaacaaaaaaccacttgtaaaaaaaggaaacaattattacatattaaatcaaggggaagtacatataatgagtgttccaagaattgtgatgcatattttgagttaaataagactaataaaaacataacaaaaagaattggaaatattccaaatgtattaagaaaagaagaaaaaaaaggaagacatataataaataatacgaaagaatcaaacaatgaaaattgtagatataaggaagaaaaaaatataattataaatgaaaatggtgataaatcattttatcagggagatgatatagaggaagatttatttaattcaaacttgaacattttagaaagtgaaaaaaaatatagtagacaaatatatacacacggatataatgaagagaaaaaaattagaggaagtaaaattattattattggattaaatggaataagttgtgaaatatgtaaaaatttaagtttatgtggtgttcacgaaataggtatttatgataataatcttttaacatacgaagatattgataatctttatttatgtaataaaaaattagtaaatgaacaaataaaaagtatatcttgcgtagataatatacagaaattaaatgaaagttgtaaaataaaagctataactacaaatttatatgataatattttaaattatgatattgtggttacggtaaatcaaaaaacaaatttcaacataaaattaaataattattgtagagaaaataaaaaaaagtttatatgtgttaatacatgtggtttatttggtagagtattcattgattatggtgacttttattatacaaataatattgatactaatacgacatatgataatcataataatattattagtgatttgtacaaaattaataatcttgaatttctcaaaaataataccattgtcttatcatatttacctttttataatatgcaattaaatgaaagtgataaagtaaaattactcttaaataataattcaggaaaaaacatacaattagacaatcttatcattgatcgtatatgtagaaaaaatcataaaatttatttatctatttcaaaaaataaatgtaataattcaatttttaaaatatttaatcacatatttcaaccattctttatcaatcaattatttccttattttttcaattcttttttttacacatatcctctgaatttaatatcatatttattcaaatttaacaaaaacaaattcttatataataattattcgcatttttttaatattaaaaaatttgttcaggaaaataaattaaattattccatcagattgataaaattacctgaacagttcaggttgaaatatataagtttagaggaatatataaaaaagcaaaaaaaaaaaacaaaaatatataatatatataataatatgtttaatatatataataatgtgtttaatatatattatatatacatatatataataaagaatacattaaaattaataaaagaaaatattagatttgtattaaaaaatatatatagaaaattatatggaataagaaaaaatgagcatgaatataaaaatgtggataaattaaaggatgaagaaatttgttttatgatatatgatgaaataatgaaaaataagaataataaagaattgtcagatgatgatataaagaaatttacatatttatgtaagaaagaaaagaaagatataagtaatgaaataataaatcaattttgttcatgtgctcatattgaattatctcctttttcatttttctggggtgcattattatcacaacaaatattgaaaggtataacacataaatttaaacctatacatcagatgttttattatgataggagagatttgtttccgttttctaatatatcaaaaatgtattatggaaagtatatgcatgaaaagaatttttttggtgaagaatttcacaaattcttaaaaaaattaaatattttattgattggatcaggtgctttaggttgtgagtttttaaaactgttggcaatatcaggtgtttcatccaatatggataaaatatcaaatcaaatacataataataaacaaaataacgattttaataatataaagaataaggataaattagatagtacttcttctaatttattacatacaaatcaaaatacaaatgtatatgttccaagtaatatggaaaaaaaaaacaatcatgttatattacaaaataaagaaaacaatatacaaggttgtgttcaggttgttgattatgattacattgaagaatcgaacttgtctagacaatttttatttagaacaaaagacattaataaattaaaatgtcaaatagcttgtgaaaatattaaaatgataaatgatgatataaattgtgattttttaaaaatgaaagttgatgatactatttttgataataaagattttttattaaaaagatacttactttttacaaataaaaagaatgagattgttaaaaaacaaaaaacaaaaaatatacgtgagaatcctcttatatgtatcttatgtctagacaatttaaaaagtcgtatattaatggataaattttgtttattgaattcaatacctttaattgaatctggaatcgaagggttaaaagcaagtagtcaagttgtgtatcca

SEQ ID NO: 287 - DNA, 1575 bp, Plasmodium falciparum
atggtcgacgataagaataaggacaagaattgctcaaaaaaagatgagaaaaataataagatagatgaagataaagaatttgatgaaaaagtaaaaaatatgagttttgatgataaagtaagaaaaatattagatttaaaattagaaggaaataatgattataaaaataagaattatgaaaaagctataaataaatataatgaaggaatgaaatatatgaaaaaaatagaaaacaaaaatgagaaaattaaagagttagaaatagctttatatttaaatttaagtatttgttattcaaatgtagaaaaatataatgaagcttatgataatattactaaggttttaagtttggataaaacaaatgccaaaggtatgtttcgattatgtcagatcgaatttaatcgttgtaatttcgatgttgctaaagataagattcaagaatttattaaaatttatccagataatatagaagccaagaaattattaaaaaacattattctaaaacaaaatgaacataataaaaaacaaaaagaagcgttttctaaaatttttgaaaaagcttcaggactttatgatgacagagaaaaagaaataatgagaaagaagaaagaaaaatatgaaaaggaaatgaaagaaagaaaagaaaaaaatgaagatattataaaatttgaagaatgggaaattctagataatgaaaaaagaattaaagaagatgaagagaaaagaaaagaaaaagaaaaagaacgagaaaaacaaaatgagaaggaaaaacaaaaacaaaaagaaatggaaaaaaaaaataaaaataaaaatgattccttaatgtctagttcaacaactaataataattcatcttatttagatatagatgaagaagatcaaaaaattattaatgaaaccaaaaaaatgggatattgttattttaaaaaagatattaaagaagatgataaaaaattctttgaaaaaaatattcccaaaaaaattgatacaacaaattatgaaaattcaaatacattatacaataatcaaaataataaagctatatcatcttggaatgcagcaggaactacatatgaagaaaaagatatgactaagtgggcaaaaaataaaatagaggagtgtttaaaaaatatacattttaaaaatgatgacgattcagattttttaaatctaaataatcaaaatggaaataatttctcatcagtaaattatccagatattttaccaattcaatatttatccaaaatacaattaaatgatgtaaaaaatttatctgttgatgctcaaatagttgttataagaggtacaaaaagacatatttttgaattgtcatgtaatttagatattaccattttcattaatataacagaattacatgtgcataaagttcttgtagaaataaaagaactttctagtgaactagaagctggaaaaacatggaaaaattttattaccattaaaaagaatgataagttaaaaattccggataacctttttaatgatatatatgatttcgtgattgaaaaggtccaacaacaaattaaaaattttacgcaagagtataataaaatgtaa

SEQ ID NO: 288 - DNA, 1056 bp, Plasmodium falciparum
atgaagagtaatatcatattttatttttcttttttttttgtgtacttatactatgtttcgtgtaatcaatcaactcatagtacaccagtaaataatgaagaagatcaagaagaattatatattaaaaataaaaaattggaaaaactaaaaaatatagtatcaggagattttgttggaaattataaaaataatgaagaattattaaacaaaaaaattgaagaattacaaaacagtaaagaaaaaaatgtacatgtattaattaatggaaattcaattattgatgaaatagaaaaaaatgaagaaaatgatgataacgaagaaaataatgatgatgacaatacatatgaattagatatgaatgatgacacattcttaggacaaaataacgattcacattttgaaaatgttgatgatgacgcagtagaaaatgaacaagaagatgaaaacaaggaaaaatcagaatcatttccattattccaaaatttaggattattcggtaaaaacgtattatcaaaggtaaaggcacaaagtgaaacagatactcaatctaaaaatgaacaagagatatcaacacaaggacaagaagtacaaaaaccagcacaaggaggagaatcgacatttcaaaaagacctagataagaaattatataatttaggagatgtttttaatcatgtagttgatatttcaaacaaaaagaacaaaataaatctcgatgaatatggtaaaaaatatacagatttcaaaaaagaatatgaagacttcgttttaaattctaaagaatatgatataatcaaaaatctaataattatgtttggtcaagaagataataagagtaaaaatggcaaaacggatattgtaagtgaagctaaacatatgactgaaattttcataaaactatttaaagataaggaataccatgaacaatttaaaaattatatttatggtgtttatagttatgcaaaacaaaatagtcacttaagtgagaaaaaaataaaaccagaagaggaatataaaaaattcttagaatattcatttaatttactaaacacaatgtaa

SEQ ID NO: 289 - DNA, 2484 bp, Plasmodium falciparum
atgaaaccaaatgataatttagaaaataacatgaatttgagtataggaaaaatagatttgagtaatatttatatggacatattacacatacatgaaactcttgtaaatcatattcaaaccatcgttacacaagtttatagtttgatagaaaagacattatgtgatcacatcgaaagaaataaattggacatatatatgtttgaagaaaagtataaagataataatataatagatggggataaagataaaatgataatccattctttaaataatttgaataataattattttggtaacgatataaaaaataaatttattttagagaaggtaaatgaatgtatattagataatgagaatgataaaaaaaataagataaaaataagttctaagaagaaatattttaatgaattactaaattttggtaataaaaataaaaatgtacaaataaaaacaataactagttcgatatgtacatataaaaatggagttgatgatgaacatgaaaatgataatgatgatgatgataatgattgtgacgataatgattgtgacgataatgattgtgacgataatgattgtgacgataatgattgtgacgataatgattgtgacgataatgattgtgacgataatgattgtgacgataatgattgtgacgatgataataataacgataatgatgataattatgaatgtataaatattgatgataataatcttataaacagcataaaaataagaaacgatgaaaataaccttctttttaataataggtatacgaggaatcatcacgataataattctgtaaactgttttatgaatataaataaaaaaacaaaggaagtatataataatgaatgtaataataattattttagagaagagcaaaaaaacaatttgtatgatagaaaaaaacaaaagtataaaaaaaaagccgaagatgttgttcataaagtaatgaataataaatgtatacaaaacgaaatatatgaaaataaaattaaactacaaaaacatatagctcttttggagcttattaaatatgttattttgtattcaaatacaaatataaaaaaggaaaatacagaaataataaaaaaaagggaaattaatgaaattaactcatatcaaaatgggaatgttacaaataagagatataaaaagggtttacataaaaatggtatacatgaaaatgacttacatgaaaatgacttacatgaaaatgacttacataaaaatgacttgcataaaaatgacatacataaaaatgacatacataagaatgacatacataagaatgatttacgtacaaacgacttgcataaaaatgacatacataagaatgatttacgtacaaacgacttacataaaaatgacttacataagaatgatttacgtacgaacgacttgcataaaaatgacttgcataaaaatgacttgcataaaaatgacatacataagaatgacatacatacaaataacacatgtcttaatgacactcatatgagtataaatccttatgataaccattacacagaaaaaacaaaaactgatttgaatcactccgaatatgataagggaataaaagatgaacatacaaatagtaatattaacttatcaaacgtcaaacttaaatatattaatattataacttattatatggatttattatcaccatttaataaatgttattctgaaaaaaatggtacaactaatgaagatcaaaagaatttaaaaatggtatgtaaaaaattagatcaaattgtattgaattatgaaagtattatcgaccaaattttaaaaaaaggaaatctaaattattctgatataaataaattgtatcaagctcataaccataataatatggaagaatattcctcatctcaattaaatgatgaaaatcaatgtgaaaataaaagggtacagaacaatatgtgcataagtattgataacaaaataaatatgaagaacaaaagtattccgtgtgaatgtacaaaatgtttggaagaaaaaaacacaaacaagtttatggacaccgcaaataatgagaaaaataaaaataataacataaataaaaataataacataaataaaaataatgacataaataaaaataatgacataaataaaaataatgacataaataaaaataatgacataaataaaaataatgacataaataaaaataatgacataaataaaaataatgacataaataaaaataatgacataaataaaaataatgacataaataaaaataatgacataaataaaaataataacataaataaaaataataacataaataaaaataatgacataaataaaaataataacataaataaaaataataacataaataaaaataataacataaataaaaataatgacataaataaaaataatgacataaataaaaataataacataaataaaaataatgacataaataaaaataataacataaataaaaataataacata

SEQ ID NO: 290 - DNA, 1227 bp, Plasmodium falciparum
aaattacttgctcccaaaaatgacgtcagaactttgaaggttcaaacagtagcatcattttgcaatgtgaaattaaatatgccgaactttgaacttggtaaagataacaagacagccgattttttaaaacactctccgctaggtaggttgcctgttttggttacgtctcatggttctatttttgaaagtaatgctgtttgtaaatacctttgtagtattcatagagaaggggattatttaggtaagggttcttttgaagaagcacaagtaaatatgtgggtagatttcaacacatacgaattagaaattcctatgacttgttatatgaataataaatcctgtgagaaatctttaaaacatatagaagatactttaaaatgttataataatcatttattatataatcaatatatggttggtaattcaattactattgcggatatctttatttctgtcatattatatttttctttaaattctggtgctttgaatgaatcgatagttttgaaatataaaaacttatatagattatatgacactataagtaatcaaaaacaatttaaatatgtttttgcttgtgatcaaaataaaaagaaaaacacacaagataaatcaacaggtgcaaaaaaaaaacaaggaaacaataagaaagatgataataataataataataataatgatgctgataatcaacatgctgatttattaagtgatgatttggcagaaaaaaaacagccaaaaaaaacaaacccattagatttattaccaccatcgaatttctcactggatgaatggaaatataaatttagtaatgaaaaagatttattaaataatgccatgccacatttctggaaaacatatgatccaaatggattctccttatattatatgaaatatgataaattagaagatgaatgccaaatatcatttgttgcatgtaatatggcaggtggattcttacaaagacttgaaaacaatttctcaaaatattcatttgccgttgttactgttttgggagaaaataaatcatatgacatcgaaggtgtctggttattcagaggtacagacataccttttgaaatgaaagatcacccttcttttgaatatcacatttttaaaaaattagatattaataatacacaagacaaaaaaattgtagaagagtactggtgctcaaaagaaacggtagataacagacctcttgtcgacagaaaggtatggaaataa

SEQ ID NO: 291 - DNA, 660 bp, Plasmodium falciparum
ggaaacgttagtactaatgttgacgttgtgaataccactcaaggattaagcaaaggaagaattttaacacaaggagatcatcacgaagaaactgaagatgtaaaccataaggctcatcatactggagaacgtactagttatacagaagtaaaacatagacgttcatcttccaattctcatgtagaatcaaacacttttcaaaataaagaagaaactgaagtaaatgctgattctgcagaacaacagaattatgataaagaaccaagtcaaaaaggtaaagatgttaaaaaaatgttaaagaaagctgataattttattgaaaccaaattagttagtgctttacatccaaaaaaaaatcacttattaaaattagccattcttgcattcccaatattcatggaacatgtctctaatatatttaaaagaagaggattcaaatatattggttctgctatgcatttagtttgtcttgtattctatgtttacatatttaaagtaattgttaatcatttattaacaaataaagaagacagatttgctcatatggaatcacatggaaaacatgcttttgatgataataaatctaaaaaaaaaccaaaagataacaaaagatacggatctggaagtcacgatcacgaggaagaagtagttgaagcttaa

SEQ ID NO: 292 - DNA, 1341 bp, Plasmodium falciparum
aataacggagatcgaaattccttatcatgcgttgatttgaataatgtatattccagaaatttgtctgaatcacaagaaaaccataattcgtcctttacaagaactaatttggtagagaatgaaaacgaagaggatgatattttcggtgttcatagagatgagtcatttgcagagactgttttgaatggacaagatattattagttatttagaacatcaaaataccaaaattcatgaagataatattcatgatgatatttcacatacgttgttaaatgagggtgatgtacaaaattattatgatgtattaaatgtaaatgagcactctgatctaaatgaacttaaaagaaattttcacaacttatctttacaacattatccaaagataactagtgataacagctttgagttaaatgatgaatttaatcaattaagtgaagcatatcaagtattaagttatcaaataagaaaaaatatttatgataatgaaggagtatatggaacaaaaaaaatggctatagtaaatccacttatatattttaatggaatatttacaactcaattaatgcatgaatatatcggaactaccgaggtagcccaatttgttcaattatttttagaaagaaacattgcacctgaaaatatagtatctttccttgaagaatctgttagtgatatgatgaaagggcaagattatagagaattacaattaactgaattgttaaaacaaaaattagatttatatatcaatgatgatgaaaaatggcaaaatataattaaaagtgaaataaatgttttaacaaaatcaccattctccaaattcattttagaagctgtgggttggacttatgaaaatgtaggaaatatatatatggaacaaacagataattttgataacgtatatcatggtatatatgtaaatttagctgatgaaagaattaatagaaattatgctattttggatgaaaatgtaaatgattttgtttcattattaaaaaaattttatccttttaccgaaactgttaatccatatttaagaagagcaaaacataacttaaataatttacaaggtggaatcaataacttatacagtagtgttaatgtagtatatgataatttatttaatgaaaatattaatatatcttctaacgaacactaccatttattacaagaattattaaaaattatattaaacatcaatttgtgcgatattgaggaaactataagagaatgtgcatataatgtactaaaggataaaacagtagatgcaagtgttcattcaaaaagagctcacagaatgaatatattaggaagcttaatgttagaaagttctaatgaataa

SEQ ID NO: 293 - DNA, 894 bp, Plasmodium falciparum
atgttgagtgttaacaaagttaccgctttattatttttctatattttactcataaaaggatattatggaaggaccgaaagtaaaaatatattaaacactgtaaagaatgatgtaaaaaatgggaattatcagaatatgatgaattttccagatatggataaaataaaagaattaataaatcagaataaagttgaagaagcaagagaattatttaatgaaatgcaaaaacaatttatgaaagaaaaaatggaagctaacaataatatgaataataaaaaaccagcaaagaaagctatggataatagtaatttatttagtaatttaattaatcctaatgatcttcaagaaatgattaaattttatatgtacttacaaaatatactaaattccaaaaacgaaacttcagaaaaaaaaatggttaaatctttcttaagaaaaactatccaaaaaatgaaagataatgaaaatagtgaagaaaaaaaatctattgatgatataataaaagataccgaaggacacaatgaaatgttagaaaaattagcaggtcttatgaaaattaacaaagaaaaattaaaagatgaacaagttaaaaataaattaaaccaaatattaataggtatgctcaaattcatagattatactaataatagtgatataaccaactcattaatggatgaaattcaaatcgaacaagtacaagcagaggacggaacaatcaaaccaaaagttcaagttaacataagtaatagtaaagcacacttagatatgttacaaaaagctaccaattttatgggtattaatattgatcaagaagaattaaaaaaattaaccgttaataataaatggtatgaaagctttttaaataatctacttaacagttcagatgaactctaa

SEQ ID NO: 294 - DNA, 1065 bp, Plasmodium falciparum
attattataagcgcagtttcagattacctgaaaaattattgtggaattataattacacataactacgatttattaaacaaaatatgccagagcgaaaacatcgtttttaaaagaattagtaaagatattaactacctgaaagaacaagataataaaatagttggtaaattagaagacggtatttgtaaaaacagtgaagccttagaaacatgtagatatacaaatatagacccacatgttttaaatttattaaatgtatatgaaaaaaaatataaatttattcataatttaagtaatacactatataccaaatttttagaatatattcaatatagaaaagatgggaagtgtctcaatgacttttttgatcaatatataaatgatataataaaacaaaagagtgataaacatgaaatacaatataatacacctagtaatatggaaaataattataatagttatagttcaaatgatcaaaagaattatatatcagaaaatcacaagtatgattataattatgatatcgattacataaaagataaagaattaaaaaatataataaattctaataataatatacaagaatttttaaacaattatgataagacaaggatacataatgataatccaactaatcataaaccagatcaatatgataactcattagtttatgatgataaactaaatgttataattaaaaaaattgaagaagcatcaaataagaaggttataaaaataggaatgaatgaagaagtacctatttattataaaaataaaagtattgtatatattttatgtattttttcaaaagatgaaaatgatccatatttttatataggtataagtgataatatttcagaaaggataaaatgtcatacaagaaatctattaaataataaaaatcttttaaaaaatccaaagaaaaataatctattaaattataaatatgattggactaaattctatattttactttttcatgttgataataaaatggttgcatccaaatatgaaaaggacctttcgaatttgttgaagaataattataacatattatctaaataa

SEQ ID NO: 295 - DNA, 1158 bp, Plasmodium falciparum
atggaaaacgagtatgcaacaggagctgttagaccattccaagctgctgaaagtaatgaaagatatcaagatcctcaaaattacgaactgtccaaaaaggcagtaatatttacgccaatatattatttcgatgggaattcatggacagctttagaaagattattaagtcttaaaaagaccatatttcatgataatagacttgttacattgtgccctgtggaaaataatataaccccgatcgaactggaggcttctattagtggcaaatatgatattaaggtttatagacattgcgaatatattttatgtattgagggggaacagaaaatattaataaaaatacctgttacgaaaaatattataacatggaattctgaacaacgccttccattactaccaaaaacatggaaacctaccatttttcttttaaatgagagcaatatatttcttaggtttattccggataaatgtttagttattagccaggtgagtaatagtgattcatataaggtaaattgtattaatttctctgaaggattttgttgctgtcatccaataaataatttagcactattatatggagagtatcaacaaaatcaagaatcaaaaattatgaaattaccgaaacttcccataagtaatgggaaatataattactttatacatttttttacatggggcactatgtttgttcccaaatattttgagttatcaagaggccctttatgtaatttcaagaaaaatatcattgctttattaataataccaccaaaaatacacatttctattgaattacatagttcctctcctgtagtatgctcaatggaatataaaaaagattttcttattacggcaagaaagccaaatattacagatatagagatatatacaatcatacaagatcaattaataaagtatgatttttcatatgatcttcgtttaaataaagaaaatgcttcaatatcacatttaaacattccaataggttttaaaatatgtaatgaagaaaaagagaaaaaaaaaaaaaattcttctcatatatgcaaatggacatttattgaaacaaaagatcaaagaacattaaatagatcaggaaactcatcatccgaacatatcatgtctcaagatttggcttgcatatttgatgcagaaaaaggt

SEQ ID NO: 296 - DNA, 2325 bp, Plasmodium falciparum
ttatattttttaatattttcaaattatttcttaatatttaatatgtgtcctcatccattaatacattttacaatgaacagtttccgttctagattttcctctattatcaagaaaaatatattttattttaattttagtcgttataataatataacgacagatttatatattagtttatgtagtgctttagaaaataaatatatattagtaaccagcccgacatgtataaaatcattatttttaaaattaatttcaactatacaagaattaaatagtatcaaaacatttgacatgttaaaacaaaaggccaaaacacatattacagatgctttaaccaaatttttaggttttcagaatgaagaaacgaaaggtataaattctggtgtatcaaatacgatgtcattagcaaaaactagtataaataacaacaactataataatattaataataataataataataatattactatgggtacacaattttcaaagaatggttccatgagctctattccttcggattacaatatgttaaagaaacagttagatttatgtgttcgtatctttgacatattaaataagagtattttattaattgatgaagtagataatgtattacatccattaaaaagtgaattacattggccttacggtattaatagagatattgatttagtaaatgtagtacgaaattttacagatatatttatgaataatccatatttaaaatttttatataataataaggatgatgaaaatgtagatatcaagaatgtaaaaatttcgataactaatgagatgaaggcaaatgataatttgatatataatataaaacatttgaaggagaatgaagaaagagagagagaacaaaataaattattaattaattataatacagatcatatgttaaaaaatgaatataatatgtataataaaatggaggatatgataggaagacataagaattcgattgatttaggtgaaaagcatattatgatgaataatatgaattattcaaaatataaatctcctttatataataagaagaaagaagatttatataatgatcatcatgatgataatattataaataataaaagtacaggatgtgtagtaacaagtggtgatattgtcaaagcattgaataatacagagaaagatataagttttactcatattgatttaagtttatttagatataaattatgttggattttaatcgatttctttttctatcctatatgtaaaaaattgactgttcctatgaatgtacattttaatataaatgctgattatattaatgatttgttattagtttttaataaggaagtagatatcggtgtaaagaatcatgatatttcttttataccacattttcatataattaattataaatggtatgataatatcgtatggattttagctaggtatacttattattttttattatcgtataagttcaatggtttatcacaaaagattgtggaatcgtatttatgtattcctctttgtattggatacaacgatattgtaagtaataaaggaagaaataataatggaaacatgaattatgctactatgagaagattattaaatataaaaaaaattcacaataaaaattataatatgaatataaataatgtacatatgaataacatgaatgaatctgatatttgtttttctaatgattatcatttaaaaattttcgaaaaaataaatcaacttgaatttgtattttgtaaaatgttaaatttatgccgtctatatattaatggaatattaccattcgtatttacaaaaattaatacagtgcattatggtatattatccgttgaacaaattaataagtgtaaaattattatgagtaaaagtagatatttcttagcagtaccttatataggaaaggatacaccttctagtatgtctgaatatactaatgtggatgttgtagtagctttaactatattatcgtatagatatcaaggaatgaggtatgttgattttatgctgtctcttaagaatattttgtataattattcattagaaaaggataatgagcatatacaaaaggatacatcagacgatagttctgatacgactttgaacaattttataacggatgaaagttcaagtgaatcttctcattctactaaagcgttgtcagaagattctacatctaggaaaagaaatatatccgagcgaagagacaatatatcccaatctttaatatcaaaaagtatagacaatgtgaatgattcggaaaatacagaagaaagtttgaatgaagaaaatggacaagaagattattcttccaatattgaaagc

SEQ ID NO: 297 - DNA, 1884 bp, Plasmodium falciparum
aataataaaaatattgttgaacataataatatagataagatagataataaaatagaaaagaaagagaatacatataataagaatattctagatataatgaatattaaagattgtggtcaaaatatgttaattgcttgtaataatattaatataaatatttataattataatttttggtttactcctatagaaattagtgataagaataatttaagaaaatatttgtcaagacaaatacaaattgtttatagtgtttgtaaattttttaattctgatcgtaaatttattgatgctcatgtaaatttattattacaatatttaaattttaatccacctaaacatcgttttaattattttaacgaattatatttaataagaagacttatgaaagaaaaccaaaatagtggtcttaaaaatattgaaaagaatttttatgcacctaaaaaattacaacttgaaattttagagaaaaaattatttgaaggtaatggtgatatatacgcttttaaagttattcaggaaagggtaaggcaaagtttaaaagggaaaaatttaacattacaaaaaatatttgaaaaagatttaaattatatatgtactatggaagatataagaatagtattcgattatttaaatataagggataagaattgtattaacatattatttgatgtattaggaagaaatattactctgcatgaattatgtttatttcttaatcccgtagaaaatagaagagataaaaagtacaatcgtttagaaaaaaataaaaggatgaatggaaatatgctacagaatgatatgaattatataaataataatatattacaaacacaaaatataggtattcaaaataaggggaacaataataataataataataattacattgatcatcaacataataatcttataagagatatcgaaaaacatttaaagaattttagatttagtttaacagaacatacacatatgaaattagtatggtcaggaaaaatagcacaccagagaatacatcatgatatgacacatgagaataataaaaacgaaatgtgtagtatgaataatataaatccttcatcatataattttgctaaaaatgaatcacaccacaacaatatgaataataacaagaacagctttagtaataataataataataataataatcaatatgattatgtgaagaaatcatcaacaaatgatttaatcagtgatatattttatacattccaaaataaaacccataatagagatgaaataaatctattaagtaatacaaatcaacaaaataatattaataagatgtcatataatgaggatatgttttatatatatgaagctgaaaatgttgatccaaaggatagaggaattatgagtaaaaataaacataaaattgtatgcggtcattacgcatcaaataaaatgtatgatattaataataataataataatataaataataattgtagtaataatatatataacagtattaatgcttttccaattattgaaatgacggatattactattaatagtatgtatacaagtacatcaggaaatgatatgctaaatttattatttccatatccaaaaaaatatcttttattatggcatgaagattattctttaaaaaatgtaaatgaatgtttacatatatggaaacctatcttgtcttcttcagctcatttttccaataatatttttgttggtcatgtagctacagtaggaccacaaagcccaccattaaataaaattagagctattccaaaggtacttgtaaaaaatgttcaatcaaaaaaatattccactttttttgcggacaatagttttgctattgataattctggtgttttcagaacattaaacatacacttttttaat

SEQ ID NO: 298 - DNA, 2349 bp, Plasmodium falciparum
atgagtttctatttgggtagcttagtaataatattccatgtactcttccgtaatgtcgctgatggtataaatgtaaacggagataataattatgggaaaacaataatcaataatgatttcaattttgatgattacaattattggacaccaataaataaaaaggaatttttaaattcctatgaagataaattttcaagtgaatcctttttagaaaataaatctagtgttgatgatggaaatataaatttaacagatacaagtacatcaaataaaagttctaaaaaaggacatggtagaagtagagtaagatcagcatcagctgctgcaattcttgaagaagatgattcaaaagatgatatggaatttaaagcttctccttcagttgttaaaacatctactccatcaggtacacagacatctggtttaaaatcatctagtccatctagtacaaagtcatcaagtccatcaaatgtaaaatcagctagtccacatggtgaatctaattcttctgaagaaagtactactaaatcctcaaagagaagtgcttcggttgcaggtattgtaggtgccgacgaagaagcacctcctgcaccaaaaaacaccctcactccattagaagaattatatcctactaatgttaatttatttaactataaatattcattaaacaatatggaagaaaatatcaatatacttaaaaacgaaggagatttagttgcacaaaaagaagaatttgaatatgatgaaaatatggaaaaagctaaacaagacaaaaaaaaagcacttgagaaaataggaaaagaatcagacgaagaaccttttatgttttcagaaaataaatttcttgaaaatcaagtaaaagaaagaaatgttgctggatccttttctcgatttttcagtaaattaaatccttttaagaaagatgaagtaatagaaaaaactgaagtatcaaagaaaacattttcaggtataggttttaatcttactgagaaagaagctaaagtattaggtgtaggtgtaacctatcaagaatatccagaaaccatgttatataactgtccaaacaattctaatttgtttgatactatagaatcattacaaggaagagtaattgatattaaaaaaagagaaagcatgatatcaacaactttcgaacaacaaaaagaatgtttaaaaaatatgggtgtacttgatcttgaattaaacgatacacaatgtaaatttggtacatgtataggtagctttggagaacatcatcttagattatacgaatttgagaatgacttattaaaatttcatccaaatattgattatttaactttagctgatggatataaattacaaaaaaatgatatatatgaattatcccatgtaaacttttgcttattaaatcctaaaacattagaagaatttttaaaaaaaaaagaaatcaaggatcttatgggtggtgatgatcttataaaatataaagaaaattttgataactttatgagtatatctataacatgccatattgaatctttaatatatgatgatattgaagcatctcaagatattgctgctgtattaaaaattgctaaaagtaaattacatgtaataacatcaggtttatcatataaagcaagaaaattagtatataaaatttatagtgaaattcaaaaaaatccagatgaactctatgaaaaattaacatggatttatgataatatctatatgattaaaagatattatactgcatatgctttagaaggtgtctgttcatatcttgaacatgataaaagtcaaatgtatacagaattacatatttataacaaaatagtcgactctgttcgttattatagttcatgctttaaaaacgttattgtttataatgctatcatttctggtatacatgaaaaaataaaacatttcttaaaattagtaccaagacacaactttcttttggattatcactttaattcaatttttgaaaaagaaattaaaccagccaaaaaatatagtacttcacatatttattttgatccaactgttgcatcatatgcttattataatttagatagaagaaccatggttactattattaatgattatttcgaagcaaaaaaaaaagaattaaccgttatagtatctcgtatgaaaacagatatgctcagtcttcaaaatgaagaatcaaaaataccaaatgacaaaagtgcaaattcaaaactagctacaagattaatgaaaaaatttaaagctgaaatcagagatttcttcaaagaaatgcgtatacaatatgctaaattaataaacatacgttacagatctcacttaaagaaaaactactttgccttcaagagattagattaa

SEQ ID NO: 299 - DNA, 1563 bp, Plasmodium falciparum
atgatcacgagtacatatcaccctggagaaaaaattgagaatgagtttttgaaggaaaaaattcgctccaaaattaacgaaatgttaaaatggaaaaggagaggtttcccaggttgtaatcctgtatctttaacaaatcataatataaaaaatttatttacgaaagagtatttaatatgtgagaagacggatggagtacggtactttttatttatagcatcaaatacaacatttttgattgataggaattatgaaatttttaagaatgatatgcatatacctaccatagaagatttatccaaaaaacaacaactaactttattagatggagaattagttgaagatattatatataatgagaagactggtgtagaagaaaaaaaaattgtgtatttgatatatgatggtttatatatacaaagaaaagatataacaaatttatcttattttgaaagattaaccaatgtgtataattatgttataacacctttaaaaaaatataaaaagtctcaaaaaaataaaaaaaacaaaaataatttacaaactaatcatgaaaatgaatctctatatattgaacttgatgaaaaagataatattaaaaaaagaaaaagtaatttaaataatatgttaacggaggaggaaaatgtattgatatctcataaaaaaaatgaccatccacatattaataataaaaatatgaacgctgttaatgtgaacggtgttgatgtgaatggtgttaatataaatcaagactttaataatcataatgaaaacaataatttattgatgaatcagggaattcttatcgacgaaaataataatgggatacagaacattggaacgaatgataatataaattctttaaataattgtaacttacttttgtacaaacgtgaagaacatagagaagaaaaagaatatgaggaagaagaagatgaacgttcctattcatctgatgatactgcttcaacaatacatgaggaagaaattccttttgaaatatatttaaaagatttttatccaatagaaaaaatatgtgaacttataaaaattatgaaaaagctacctcattattctgatggtattatatttacacctttacattctccttatataacaggtaatttttatcaactcctaaaatggaaacctctaaatttaaatacagtcgattttggtatagaaactatatacgatgaatataatattcctagtaaatttgaactctttatatccataaacggagtaaggacatcttataaatgttatcttgctgaatatggagatgtctacaaagaattgttacaattagctatttctaataaaatatcacattacattattgagtgctattatgtttccaaaaatatcttctcaatttgtaaaggtgaaaatggtagagaacaaaaagtagaaggcggatggatagctcaaaaaataagattcgataaaaatattccaaatgatatatcaacactaaataaagttatacaaagtatactggataacattactatagattcattaatcaaagaaatatccagaaatagaaaagcaaagtaa

SEQ ID NO: 300 - DNA, 2706 bp, Plasmodium falciparum
atgaggatggattaccatgataaatataattatttcatgaatataaagcaacattttttctttaaaaaaaagataaaagaatttaatgtaaaattaggaggtgacaatgtaacaaacaaatccttactgaatatatccgaaaaacaacccaagtttgaaaatgaagaaaatgaagatagtaataatataaatgagaattttgaatatgtagatgaaaaaaagaagactaaattaaatagtaagaacagtatgaataataagttcaataataataacatgatgaatgataacaacatcattaattgtaatgataatcctatttttattgaagagagtatacccaaacttactcataacataacaacagatattcaaaatataggtagtaatgaagatacacaagataatatcttatcttcatatgagagtagttgcactaatgatacatattgtagtagttattatataaaggataataatttaaaaaatgaatttagtgattcttgtagtaataatatatataactcaaataaagaagagttaaatgattttatggataatgaaaatatgaataatgtacatgaaaaaaaaaaagaatgtacccataatatagaagatggtaatgctataaatgaaccattatatgtagaacatcatatacgacgaaataatgataattttgatcatataaattataatgaacatggtattaataatgtaatgaatcccgttaataatatgatgagtatacagatgaattatgattcatccataattaatacagataaaaagaaaaaatgtgaacatattaataacacaattgaagaattagataatttatgtttaagtgaaaatgaacacattcagaatatcgaagcaaataatataaacaataaaaaaacaaatgatagtgtgacgaataaaataagtggtgccaaggctaataagggaaataacagtaataataataacaataaatcaaataataacaaaacaagtcataataataagtcaaataataataataaagatgatggtagtaagaataataacaataataataataacaatagtaataataataataataataataataactatggaaataataatagtaaaaaaaataataataataataatgacaataatgataataataataataataacaacaataacaacaataacggtgataataataaaaataataataatgatgaagatgatgatgataatgataataatggagataacaaaaaaaataaaaaggataaaggtaatcataaagacacatcaaacaaaaataataacacggataaaattaatgatagtcatatggttaagtctgataaaaaaaagaaaaatacaaaaaataacacgaataataaaaataattcatccattagtaatactataaatatgaatggttcatgtattgtaaataataataataataataataataataataatattacaaatccaatcaataaaaataatgaattatataataaattgtataatatgaaccctccgaatacatatgataatcatgaaaatataatgaatcctgaagatgttgtaaatataaaacatatggatatgaaaatatatcctaattttggaaacatgaataatatgaatataatgaataatgccaatatgatgaataatgtaaatatgataaataatgtgaataatatgaataatatgaacagtatcaacaatatgaacaatatgaacaatataaattatataaatgatatggtagatacaaatggagtaggcaatttttttaatatgccaaataatggatttattaatatatgtaataataatggtaataataacaataccaataatactaataacaataataataacaataataataacaataataataacaacaacaataataacaataataataattacatgtcaaatataaattatgttcataaccctaattatatacctaatggtaatattaataaattaaatataaaaacaaatatacattctagcgaaaatgatatgatgaataataatttcaatccaaataatggtatgtttacatctagttattctgagataaatatgatgagagaacaagacgatttaaacaatatgaataatggtctctttatgaattacaataataatatgatgatgatgcaacatggaaataatggtgatatattttttaatgaacctaataaagataaattatatttaaataatgaatcattgaataattatcatgatgaaaaaaataatagtaatacgaatataatatttttaagtggtactatgaatccaaaatttgaagaatcaaatattacaccaaaaaatggtttacattatgaaatgttaaataataaagaaattatgaatataggtgaattaaaggttgaagaaaatgatcttatgcatggtatgccaagaaatgattggatgtataataataataataataataatataaatcatatgaatcacataaataatatgaatcacataaataatatgaatcatataaataatatgaatcatataaataatatgagtcctataaataacatgagtcatataaataatatgagtattcacgaagagcaacagaataattttaaaaaccattttgaaaataaaattaatgaagaatcaagatcacataagaaaaataaaaaaagtgtttgc

SEQ ID NO: 301 - DNA, 2700 bp, Plasmodium falciparum
acaaatgtcgaaatggataatttaaatattatgaataaagaagaagatataaataatttaagtgatcattctatattatcttataagtctttaacatcaacttcgcaggataacaatattgatactgcatcttccctttcttcgaaatcattttctgcatcttatgatgaggatgaacattcgaatatttcatcgtatcatttttcagattgttcatctactatatcagatacatccgttataagtaccttttcgttatcgtattataattttgacgagaacatttcaaaagaaaataatgaacataataaaaatgaacataataaaagtgaacataataaaaatgaacataatataaatgaacataataaaaatgaacataataaaagtgaacataatataaatgaacataataaaaatgaacataataaaagtgaacataataaaaatgaacataataaaaatgaacataataaaaaggatgaactcaataaatgtgatgataattcgaataatattttaagtgagaaagataaatattctaataaaaaatatttaaacaaaaaatccttttatttatatgatgtatttaatatagagccaataaaatataaatatttgccctcacccccaataataaatgaagagaaaggagtaattattgcgtgtctttttgctgagtggtattttatttataaaaattacttaaatattttaaagatgagtatatcgaatgatatgcaagatgtagtaaatcaacaacacaaagtaaaatgcataaatttttttcgaaaattatcaaagaatggctttttaaatatggatgaagaaactgatcagttcctatctcattccattaatatttcggttaatatagctttgtacaatttagaaaaggataatatgttacaagaggaattattcgaaagaattcaaaataaagaaaataatgaaaatgaactaatggatgatgatatgaaagaaaaaaatgacgtaaaaaatgtatatacccctctttatgacgatgagaaaaaagatatgaataaagaacaaaaaaatgataatcatgcaaaggtacagcttatggatttacctaagaatgaaatagataaaaatgatgaagagaatttaaaagaatgtccaagtgtaagtgaattattaaattataattatatagactcatggacaaagatgattattacaatgctaaaattagttgatatcgaaaaaatatcaccaatttttatattacaaaaagtgttaaatcttatatgtagagtaatacataaaaaatatgaaagtgaaaagaaacattttaatcaaagaccatattttagattattacattgtttattaattgatattaatgagcaatgtatttattcaaatgatttattgatatatttaaattgtttttctgaaatatttcttttattatcacctttaagaattcctgctttttgtttttcatgggttgaacttatatcatcaaaatattttatgcccaaatttttgtcaaatatttgtggatgggataattataaaaaattattaattcatctttttacatttttaaaatgttttttaaaaaaaatacaagtatccaaagcaattgaatcattatatataggaacattaagaatacttttaatattattacatgattttccagaatttctagctagttattatgttactttatgtagtatatttccaatcaattttattcaattaagaaatcttgtactttctgcatttccaagaaatattaaattacctgatccattcatgtcagatgtcaaaattgatttattaccagaaattaaaatagtaccaaaaattttaacaaatataagtttcttactttttaaaaatcgtttgaaatttttattagatgaatattttcacaaaaaagattataacctattgttccaaataaaagataaattattacttcctaaaaataaaatatatcaatcatttattaaatatgatgtggatattataaattctttaactttatatgtaggaacatatatatgcaaagctaaagttaataacctttttaaatttaataataattgtgaccccataaacttgaccaaatattcagatgattcaactgatgataacacagccatattacaagaactaattttagaaaatgaacaagacaatttaaacaaagggaaaaaaaaaaataataaaaaatgtaatagtaggacaatatcaaagaaagaacaaagtaaattaaaaaatgaaaaaaataatttatctaaaaaatatgttgaacttatgaaagacgaatataatgaacctaatcaagctaatgaagaagaaccaaaaacatcaacaaaattgaatagtaatataaatggatctatcgaaagtcgaaaggaaaagaacaaatctgttatagttgttaagaataatttatcatatactctttttttatttttatcaaaagaattagatatggaaggtcgatatttattattatcaaacattgttaaccatataagatatccaaattcacatactcattatttttcatgcctcatattatttattttctctcaatcgaatgatataataatacaagagcaaattattagggtcttattagaacgtatattggcacatcgaccccacccttggggattattgataacgtttatagaacttataaaaaatacaaaa

SEQ ID NO: 302 - DNA, 1758 bp, Plasmodium falciparum
atgaaagctacgggtatttctataccccttctttttggtagtttaatgttatataataaaataataaatgataatagtaatttaagtgcacccgaaaaagtgatgggaagatatttatataaacataataataaattattattaagtaatgttttagataatgaaagatcacataatattttttattatattataaataatatatttaataatataagaatgtttataaatttttatttgaatataaaaaaagttaaatctaaagatattttgaaagaatatactatattattttttcattcatataatgtagatagatttttacaatcaagaaatatcaaaacatattcagaaagacttaaagaaatgtacaaacaaattaataaagataataatgtgaatgttatatatataccattagataataaattaatgtttaatattaaacattttagtaacatgaataattggtacagtgttttatttcatgataaagaacatatattaaaattaattaagaaatataatattatgaatatacctactatggttttattagatcgtaatatgaatattattaatgataatattaattatttattattatatgataatcaaggttttccatataaacatattaataattttacatatattaaacatgtttatgataaaaacaataatcaatataacttgaaaaatctaaattcagattatatcttcttctattttaataatagtaaggataacaaacaggatatacagactttgttaaaaattaaaaagaagttagcacaaaaaaatatcaaactcgatattatttttatacgagatatagaaagaaaaattacacaaaatgaaaaaagtgaaaaaaatgaaaagaatgaaaacaatatgttagacacaacaaaccaaaaagatcaagaaggtattagcaaaaataataataaattgaaagttgatgagaaagataaaaacaaactaagaatcaatgataataacaataataataataataataataataataataataataataataagcatggtgtagataataatgatactatgcataacaatcaaaataacaatatgcccatggaagattatctagatgatgtttattatctaggtaatttagaaaacaatgttatatacaaattattattatatgacatatttgatgttacttttaaacctattagtatcttagtcaataaaaaaggaaacttattaaacaaatatattaatgttagtaaaaaggaaaatgaaataaccacatttattttaagtaatcataaaagtttaaatgaaaaagttaatgagaaaaattatttgttcaaatataataatattagtagcatgaataatttaaatgcattttcaccaatatttattttatttagtgataaattagatttagatttattaaaacaatataatgaattaattgaagaatataataaaaatagaaaaggaaaaaaaattaatttctatttcttaccaaaccaggaaaaaaaatatgatcctttaaaaaaattatgttcaattaataatacaaccgaaatagttatattagatttatttaatcaaaaattatacaaagaaaatggaaataatattaatattataaagaaattagagaatggaaaatatattattgataaagaaaaatttttcaattttttaaataaatattatgatgatgaattatatgcttctacgattatcttaacaaaagaatcaacatcttaa

SEQ ID NO: 303 - DNA, 2799 bp, Plasmodium falciparum
aaatgttcacaaggaaacctgtatgtgttacattgtgaagttcaatgtttgaatgggaataacgagataatacataaaagatgtaatgacgacatagaaaagaaatgtaatggtaataataaatgcatatatttttttgaatatgaacttcgaaaaaaaacacaatcctttcgaaataagaatagtatagaaataagtgaatgtgtagaatcggaacagaacgaagtaaaaacatctacgacttgtttattaagtaatagttttattttagatgaagcatttattcaatatttcttttttattaagaataagaatgaggaacctgttatttgtaaagatggtaatataaatattaaaagtgcacttttacattctcccttttgtgaaataaaattaaaagatatatcagaatatattagaaaaaaatgtgataataataaagaatgtttaatagatccattagatgtacagaaaaatttattaaatgaagaagatccatgttatattaataattcgtatgtgtctgttaatgttgtatgtaataaagaagaagaaattggagatgaaagtacagattctagttcaatggaaattcaggattctacatctaatgaacaagatgaaaatgttaaaggaatgagttcatcacaagaaatgaattctaataacgacgaaaataaaaatcaagataatgaaagtgatgatgatgttaataataataataataataataatgatgatcaagatgaacaaggtaatgatggtgatgttacctcttctatgaataaaaatgaagataacaaagatttagaacatggctcttcaaatgatgttaataataatacagacactcttgttaataataaagaaaataaagaatttgtattaaaagaaaaatcaagtttaacatctaaaattaataaagaattagcacatagaaccgctctttttaataaattagctgataatatatccttattattgaataaaaaatatgattccttcgaaattaaagatgtattagaagatagatataatgaaatgaaacgtgatgcaaatccagatgtatattacatttatttaatggatacattagatatagaaaaaatagaagatataaatttagaagaagttaaaatgtcattattagcttccttaaaagaaacaatgaataaaatagatactatagaaaagaaaattgaagaattcaaaaataaatatatttcattatataataaagtaaaaactaccatgccagaacttttcgatttaaatgaagatttagtattattatataatgatttccctttcgataacggtatgatatcatctgatatattctttaaatataatccaagtgaaaatattatggatcatcaggaaatggtaaaaaagggttctataacggaagacgaattaagaattgttaatgaccttgaaccattagataattatagaagaagaaaaagaattacagaattaagaaaaattcttgttgaaaaattaagaatcttatatttagaaaagaataacttatttaatacacaagctagttgtatcaaatcgtattgttacaagaacccattgaatctaaaaacactagaagtattattaaagaaaaattattatagattaaaagaaaataaagattatgatgttgtatcaagtattatacaacatcttgataatgtcgatgcaaacaagaaaaaaaaatggcttacacatgaaagaatacttaaaaaattacaagtacttatagctgaaggatataaaagaataaacgaaaaagaaaaagatatcgatagaagaatggctgtatataatgccctatatgaaaaagcacaatcttataatttacaaaaattatttaatgatagtaatgatttcttaaagaaatatgcaataatgggtaattcttttgatgatggagatgaagtattcggaagccaatcatccaactttaatatttttgatagtaataacactgatcaaaataatgaacaagaacaaccaaaacaagacgatcaattactaaataataataatgatgatgtcctatcagaatccaataacgaaaataaagagaaaacaagcgacgatgcaactcacaaagagacacaagaaaaatcagatcaagaaccttcacaaaatattcaagaagataatagtgatgaaaaacatgcagaaaatgaggaaaatgtagaacaaattgaaacagacagtaacgtttctgaagaagctaatgacgaaaataaagacaatatgcaaacaacaactgatgaaggaactgaagaattacaacaaaatgatgaagatgctgaatctctaacaaaggaaaattcaaaatcggaagaacaagaaaatgaagattcaacagatgctgaagctattgacaaagaagaagtagaaacagaagaaaaaggaaaagatgaacaaaaaaaagacgaacaaaaagaacaagatgaagaagaagatggcgaaaaagaaaataaacataaatcaagtgaaacaaccaacgaaacagtaactgacattgaagaaaataaaaatgaagtaaaaggtgaagaacacctacaaggatcagaacaatcaatagaagcatctgaatcatctcaaaaagatgaaactaaagaaacagaagataaagaagaatatgtaaatgcaaatgatgatgaatctagtgaagaagatacgactccaaatgaaacaaacaaaactgataatggcagttcatttttctttgctatgagtaatgcactcttagtaattttacttttattatttatagaattcctataa

SEQ ID NO: 304 - DNA, 1812 bp, Plasmodium falciparum
catcatatgaataaaaaagtaaaaaaaaaaaataatttttttgttatgatggatgagcatctattagatattatcactcattatattattaaattaaataaggttccgttgtacttacgattcttaccttcatataatataggttccatgacagatattaaaaatgaaattaaaaaattacaattcctaaacgagttctataaaatctatttcgaaaaatataacaaatggaaagtagttattataaataatcgtatacatatatttgataaggaaaaaaacaaaaataaaattaatgcattagataataactctacagaaacaaaaaataatcaagaaaacaaaaaattaacagaagaagaaaaagaattaattcataaaaaaatacaaaaatttaaagaaactaatcaactcagtttcgatccaaaggaaaaggacaaaaaaaaaaaaaataaaaaacataaaaattacaacaaaaacaatacacattatgaaaaatcagaaaacaatacaacagttaacaatacaaataaaggtatttgtgataagatagatgaaaatgaaacaaacacacaaatgaaacatcaggaaaatttttatgactctcaacaggaagaagaccaagacgaggaagacaatgacgaagatgaaggtgaagacgattatgatgatgaagatgatgacgatgaagatgatgaagatgatgacgatgaagatgatgaagatgatgacgatgaagatgaagaagatagttatgatgacgatgaagatgaagaagatagttatgatgaagacgaacaagaagaggatagttatgatcatatcaatgaagcaaatgataaattggtacatcaaaatggtgaatataaccatgccataaaagaaaataactataaaacattacagaatcaagaaattatacataataatgacacaaatcaaaaaaataataaagtatcttctataaataaaattaacacaaataaaatacatgcaaactatttattaggaaaccccgtaaatttgttttggctaggaggccctcttcctggattaaccattttacataatatgaaaaaatattcaaaaaatgtcgtagtgaatgatttgatatatgaagggtataatgaaggcgtaaacgaaagtgtaagtgaaaatataaaccaaaatataaaccaaaatgtgaacgaaagtattaacacgaatgaaaaaataaacatgttaaataatgtaagcatgaacaacagcgtaaatgttttaaataacgtaaatatgaatgataatataaatataatacataataataatgttatgttaaatgataactcaacgaacaatttcacatgctcaactatgtccaacatgaatgaagaacagtacaatatcaaacattgtaatatcataaataataataatttcaatgatgttcataataatatgaacgatggtcataataatatgaacaagggtcataaaaaattgataaaaagatttattggaaaagctacatgggatatgaaccaactcgttgatgaattgaataatgattattggatagcaataaattgtgacaataaagaattattatctaacattatatttaatgcatctaatgaaacagatagtaataatattaataataattttgataattcagcttgtgggaatgtgtcttctaattcttataaaggagaatgtctatgggaaaaaatattggcatctttaaataatgactatgaacagatatcaaaaataccacaaactgttatagataactttttaaaggattttaaaagtatagaaaatgaatga

SEQ ID NO: 305 - DNA, 2367 bp, Plasmodium falciparum
atgaataaacaatcggattcaaagccttatactaaaagtaaaagtaaattccacatgtttttttacaaaaataaatattcgagttcgaaatataacaacaataatgttaatgaaaataatgttaatgaaaattatgttattgaaaataatgttattgaaaataatgttattgacaataatatgaaaggaaacaatgtgaatgatcacaaggtaaatgatcataaggtgaatgatcataatgtgaatgatcataatgtgaatgatcataatgtgaataaccacaacatgaatgatcataatatgaataatgtaacacaagggggacatcatgaaaagggtgatgatataaattctgtaaatttaaacgtgttcccacagaattgtaatagtaatgacaagaataaaaaaaatacaactcttaataatcataataatcatcatctgaatagcagtggtaatgttccttatggtaaaaagaaaaatagtacgaatccacgaagtagtgttatattaaaaaatggagaacataacgtgttgtcgacttataatgaagatatgtataataatataggaaagccgaatgaagagatgaatagtacatgtgatataaatatgaataattataataatgttaatattgatgaggaatataataatgttggtactggttcatataataaatatcacgaccccaataataataataataataataataatagtagtagtagtaatatacatcatagtgttagtcacgtatctaattataaccaacacaatcaaggttataacaaaaatgtagttgtaccttataatgacattggtaataaaaatgaagagaaacataatactaatgaagattattttaactttggtaaagatatggggaatcctagtaataatcaacatgcaatgaataatgtatatcgaaattataagaattataataatgttgatcatacaaatgaaagctatttacatatgtctaaaaatagtaatgttcattacaataattatcagagttattataataatcataatgtacaaaaatatggagaaatccatgataacttacttaattcaaatgatcaagggcaaaagaaaataagtacctattttaactcaacacagggatataacaacaacaacaataataataataataataataataacataagtaatcataataataattattatagtacacatgctaatattactcaatttaatgcagatatgaataatagtaataatcaaaataataccacagctccatgtagtaacgaacacatgtcatcaaataataataataataataataaaaataagaacagcaacatgctagatgacttgtacaatatggaggataacaaaaatgtttataataacggcacaagaaaagattcaattttaaacaatatgataaatcatgctggtgataagaataaaaaacatgaaaataaaattcagaaaagtggggagcaaaacaaaagagatgaaaggaaagaagatacttataagaaatatgaaaaaagagataatatgcccatgaacagcagcagcaacaacaacatcaacatcaacaacatcaacgtcaacaataataataataataattataataataacaagaaagatgataaaagaattgatagcagaggatcacacaacaaaagcaataatagtaattatatgaaaggtatggaaaattgtaatatgaatataaaaaatgtcgacataaaaaatgataatataaaatatgacaatacagatgatgataattataattataataatataaataatactagtaatgatgaaagtgaacatatggatgatgtatgtaatatgaataatatgaaggatataaattgtaagaatttgaattcatccaatggaaatgcatataatatatcttatatgtttatataccaatattattatgtattacatacaaaaaaagagatgatgtacaatttttattcggagaaagctatacttctggttagttttaatgatgaatctaagataataaacacaaaagtacataataatagtgctcacattatgaataatgagaattataatacagataagcaaacacatgtcgatgacataaaaatgataaaaaacaagaacaacaacaataataataacaataataataataataataataatgatgatgatgatgtggataataatacatgtaggaatcaattttttaatttaaacgaaattaatattgaaggttgtcataaaagtgacaatatgataaaattagaatccagaaatatgatttatgaatattataaaaatttagatgtaaatgaatgtacagttcatattatttcaattgaagtt

SEQ ID NO: 306 - DNA, 2697 bp, Plasmodium falciparum
aatatggataatgataataatattatgaataacacattatatccatggaaagaaaataaattcaaaaatgttgatatgttaaatatatacaaaattaataaggatgattatttacatacagatattgttaagaacatagattgtgttataagtccatacaaagatcccaacataattatggataggataaatgatgataataatataaatatggataatttattatttacatataacgaacaaatgaacaatcatcataataataaaaaatggaacgtttttaataattctattattttagaaaagaatgaaaaaattactaatagcaaaaagaaaaataattataagatacatcaaaggcaaaatattaataaaaacgtttcagataataacgaaaatataaataataagaatgtaattagtaaagataaatttaaaattataaattcttatattgattataaattaaattatcataaaaataataaatatagttataataatatggaacataacataaaaaatgtgaatgagcaaagtagtataaataataataataataataataataatatattatatacaacaacaaaagatttaagaaataatattcatacaatcaattttaatgatacaaaaaatataattaatagtgatgattattttgtagatcataattataattataattacaattataattacaattacaattacaattatgcttatgataatatagaattatctaataaaaatatgaaagatgttattaatttatatacatacgttgttaataaaaaaaatgaaaaaaatatttacacgtccactaataatattatatgtaacgatgaatatattaaaaaggaggattgtggtgattgtcagatggtagagagtacgcagatgttcgacgaggaaataaattgttctccggaaaataaaagtaataataataataatattaatagtaataatattaatattaatagtagtagtagtagtaataataacaataataataataattattattataatgattatcatgatgatgataataataataatattatgaatcattcttattataatcatattaacgattcatattactaccaatttaatgaccttcattcaaaagagaatcaacaaaaatacacatacaatataaataacctaatacataatatgaaattattaaatacagaatatgagtctcctctaaattctgaacaagaaaaaacaattttaaaaaatatcgctgtggacagaaataacaacattaatattaataacattacattgcctactcttcaagataaccaaatgaataattataaaaaatatacaaatgatttaggatcggtatcagaaggatacacatctacatataatgatacgttaaaaatgcatagtgaaacatttatggattcgcaaaatggtatgtacattttaccacaatatgtaacacgtgaatgtattaatagtccatatgatagctctctctttacagatgaaaatagggaagagaaaaaagataataaagaacgagaaataataggtaatatgttatatgatgagcacatttgtatggatgatgaagacttattcggaagaagtcacctttttaatatatttaacaatgaagaagaaatagatattaatcaaaaggataattattatgatagggatgatcataatgattatcatagggatgatcataatgattatgatagggatgatcataatgattatgatagggatgatcataataattatcatagggatgatcataataatcatcatagggacgataataataatcatcatagggatgatcataataatcatcatagggacgataataataatcatcatggtgatgatgttatatatgaggaaacgaaaaaaacagataatatagaaatcccgttaaaagacaatgacataatgataaataattcatataacgatagtttaattaattataacaaatattttgttaaagaacatgaatataacaatataaataacaataacaaaatagaagaaaacttaaaaataaaaaatagctatgatacaagttctaaacaaaattataaagaaaataatatgtttcatgatgtggataactttacatctttactactacatataaataattataatgaaaaggattttatgaattttaaaaatgaagattataccttgaacaaagaaatatactttaatgaatgcaaatatgttaaagaaattaaaaatatagatcaggataatacaaaagagttgggaatagttttacaaaatgatgaccaaatatcggaaagcgatatgaggacaaagaaaatgatttattctattttcatcaaagaagaagaaacaaagaaaaataaaaatttagaaaatatatgttatacaaatgaacaggagaaatataataatctatctataattaatcaaaaacaaaatataacaatggatataatcaaaaatgtagatgaattatcctttgataatatggaacaaatgaatattaaaataaatgataatcaaatgtataatgaacaggtgatggataatatggaagatcgaatagaaaagataaacatattaacaaatgataatatacaaaatggtattcacaacaataataataatataattgaagaaaaacaaagtcttaaagataataattag

SEQ ID NO: 307 - DNA, 1887 bp, Plasmodium falciparum
atgaataagaacaacaataaaggtagtgttaaaaaaaacaataattccaagaaaaaaacaagcacaaatataaacaatgtgaacaatttaagtagtataaaaaatataaagaatgaacagaatgtgaaaaacggagatgtaaatgatgaaattgctactactactagtagtaaccatgttaatatggtgttgaatggaaatgatgaagggataaaagatgttaaagttgttaataatttaaatattgataacaaaagagaagataataatgttagaataaatgtacaaggagaagaaactcttaataatgatagtaaaaataaagaggctgaaaataaaagcaatataaagaataataaatcgaaccagtccaaccaatcgaacaagaagacgaagaacaacaacaacaacaaaaataataataataacaataataacaataataataataataataataataataaaaatagtacatcaaataaaaaaaactccaagaacaagaaaaaagttgataaattagacttaatattaaatgaatttaaaaatgatataaaaaatgaaaagggagaaaacaaccaaaacgacaataagttattaaacggcgctatagaaacaaataacaacaataataataataataataatagtggtaataatagaatccattttgataaagaagaaattaaagaaattaaaaagaagataatattaaaagaacatgtgttagaagaacaagataatagctctattcgattgttaaagaattggcctcaactagaaaaaacatatcagacgaatcccccatgtatccctatagatatgatatatggaaaagatgggaaatatccagttggggaaattttagaatataataattataatttaagtggacaatctttagtcgaaaaaaaagaaagagaaaaattaagtattgattattatgaagatttaagaaaagctgctgaatgtcatagacaagttcgaaaacacatgcaagcttttataaaacctggaaagaaaatgattgatatagcacaagaaacagaaaggaaaacaaaagaattaatacttgctgaaaaattaaaatgtggttggggatttcctactggatgttctttaaatcattgtgctgcacactatacaccaaattatggagatgaaactgttttaaagtatgatgatgtttgtaaattagattttggtgttcatgtgaatggttatataattgattgtgcttttacaatagcatttaatgaaaaatatgataatttaataaaagcaacacaagatggtacaaatacaggaattaaagaagctggtatagatgctagaatgtgtgatattggagaagccattcaagaagcaattgaatcttatgaaatcgagttaaatcaaaaaatatatcctattaaagccataagtaatttaagaggacattcaattaataaatatattatacatggtggtaaatgtgtacccatagttagacaaaaagaaaaaaatgaaattatggaagaaggagaattgtttgcaatagaaacttttgcatcaactggtaaaggatatgtaaatcatgaaaatgaatgttcacattatatgagaaatccagaaaaacaatttgtacccataagattaaattcagccaaaactttacttaaagttattaatgataattttgatactctacctttctgtaatagatggctagatgatttaggacaaactagacatttcatggctcttaaaactttaatagatctaaatattgttgaaccatatccacccttatgtgatataaaaaattctttcacatctcaaatggaacacaccatattattaagaccaacctgtaaagaggtactatctcgtggtcccgacttttaa

SEQ ID NO: 308 - DNA, 2982 bp, Plasmodium falciparum
atgagaataataatattagccttgttgatcgtttgtaccataattaattattattgtgctgttcaaaacaatggaaataaaagtttgaatgtaatgcctacttgtagtatgcctggaaatgatagtgatagtaatgataatgagacaggtgatgtagataatgataagaataatgaattaggaaatgcaaatgataataatgaaatgaataatgaaaacgcggaatcaaaaaatatgcaaggagagaattcaaataatcaagaacaattaaatgaaaatgtacatgctaatgatgatgccatgtatgaagggacaccttcaagcgataatcctccacaagaaaatgttgatgcaaataataatgagcaagaatatggtcccccacaagaagaaccagtatctgaaaataatgtagagaatgtagaagttgcaacagatgatagtggtaatgataatattaataataatgataattttaataataatgataattataatgataatgataattttaatgaagaaccaccttctgatgatggaaataaaaatgaagatgaactcactgaaggaaaccaatctgatgacaaacctatgaacgaagaagaagctactattaatgaaatgggaaagataactaacccttttgaagatatgttaaagggaaaagttgacgatatggatattggaaaaatgatgaataaagataatttacaatcatttttaagttcattaacaggaaacaaagatggtagtggaaaaaatccacttagtgatatgatgaatatttttggtgtaccacaaacaggaaaagaaggtgcagaaggaggagtaaataaagaaaaccaaatgaaacaaattaatgaattaaaagacaaattagaaacaatgttaaaaggtgctggtgtaaatgtagacaaaattaaagatagtattaaaaataatgatttattaaaaaataaacaattattaaaagaagctatttcaaaattgacgttagacccttcaatgatgaatatgttaaataataaagatggagctaatggaaaaccgttcgatataaatccagatagcatgatgaaaatgtttaatgcactttctaatgaaaatggaaatcttgatgacttaaaaatgaaaccaactgatggatcttttgattcatttaatgatggtgttgataataatttagttccttcgaatcctaaaggacaaaataataatgaagaggacgacgaagaaggaggtgatgatgatgattatgatgataaatcattcgttgtaaattctaaatatgctgataattcctttgaagataaatttaatacttttgatgaaaaggatgatgatgttaaatatgaattatttggtgaaaatgaagaagcagaagaacttaataataatacaactactgcttcatccaagggcgatgcaaacaatagtgtaaacacacaagaaggagaaggagaagaagaatctttttcagcaaatgaagaaaatataaataataataacaatcataataataagaactataataattataatactagccaacaagaagaggatgataacagttttaatgaaaacgatgaaccattaatatcgtcatcacaatttgataataataagaaaaataaaatgtcagtttctactcataacaaaaaatccaaaaatcttatggattctttagatttagaaagtactaactatggatcaaattcttcatcatccatgagcaacaattataacagtaaaaataaaaatagcaagaaaaataataaaaaaaaatcatcacagaaagattatataagaacagatggtaaagtttcatttgatatggctacattgcagaagacaataaaaaattttggtggtgcagataatgaaatcgtacaaaatatattaaagaaatatgtaaccatagataatgatgatgacaacgatgcagacgaagatgaagatgaggacgacgatgatgatgatgatttggatgaagatgaatttagtgttaaagatattaaaaaattaatcgaagaaggtattttagattatgaagatttaacagaaaatgaattaagaaaattagctaaacctgatgataatttctacgaattatcaccatatgcaagtgatgaaaaagatttgtcattaaatgaaacttcaggattaaccaatgaacaattgaaaaacttcttaggacaaaatggtacatatcatatgagttatgattccaaatctattgattatgctaaacaaaagaaatcagaaaagaaagaggatcaacaagaagatgatgatggattctatgatgcctataaacaaattaaaaattcttatgatggtattccaaataactttaaccatgaggccccacaacttatcggtaacaattatgtattcacatctatatatgacactaaagaaaatctaataaaattcttaaagaaaaatagtgaatacgatttatatgatgatgatgataaagaaggtggaaactttaaatctcctttatatgacaaatatggaggaaagttacaaaaattcaaaagacaaagagcttttaatatacttaaacaatggagagctaaagaaaaaaaattaaaagaaaagaaaaagaaagaagaaatggaagaaaataaagaattcgacttttctaaaaattataatttttcatctaaaaatgatggaggtgttactatgttttcaaaagaccaacttgaagatatggtaaaaaattttggaggaaaaccaagtgctcatgtaactgattctttttcacgtaaagaaaatccatttgtcccaactaatacaaagaataattcaaatgatgatgatgatatggataatggatatgttacctttgatggaaaaaataaggtctcagaaaatgatgacgatgaaaaaggaaataacaatgatgatgaaaatgataacgatgattctaatgatgaagaagaattggacgaagaagaggacgacaattaa

SEQ ID NO: 309 - DNA, 1008 bp, Plasmodium falciparum
atgcttggagtgcttaagtgcgctttcaatgcaggagtaaaagtgaaaagtgcagcggaggttggaaagagagcagtagaatattttagaggtgacgattttgtaaattttttaagtactaatggtgaaatgttaaaaaagaaatttcctaatttatttataaatagaaatttatcagatatgaaagaaattgaagaatttgctgacatgttcatacaaaaaggatatatttataaagctcaatataaaccaataaaaggaataaatgaaaaagatgaaaatggtgtttataaaagacctaaatggccaaaacgattaattatgacttcaaaacaaaattttgataaaacaagtttttatatattagtacatgaaagaaataaaaaattacaatattttatgttaataagtttaataagtatagttttaatttgttgtatgtttccagtttggccactcagattaaaattagctttatggcatatttcagtagcattcttaacattaatatcaataatcatagtaggaagattagttgcttttattttcttctggttttttggtgtagattattggatattcccaaatttatttgatgaagaatgtaatgtagtagaatcatttttgccattacaatcatgggtttatagaaatgacacatggtttttatttgtagcaagaatgtgtacagctgttttgttagccatagccatacaacaattgggtaaaactcattccattgcagatatacgtaattttgctacacaatcatatattgatattattgagtggggtaataagaaattagctgcttctcctgaaaatgtttcaatgtataaatctatagattcaaaagcaacctttgaaggaaacgtagatgacgatgataccgtttatgatgaaaatgaagaaaattatgattgtttaaaaaaatgtggatttacaagttttgaagaattagttagaaaatgtttcttaaagtgtgaatgcatggaggtaattatatga

SEQ ID NO: 310 - DNA, 501 bp, Plasmodium falciparum
atgaaacttttaagagtaacacctgaaaaaaatatagaatttcctcttgttcattttcaagcagtaactcaagttgttaaattagaaaatgtaagtgataaaaaagtagcttttaaaataaaaacaaccgctcctaataattatttagtaagaccatcatttggtttaataagtgtaagagaaacaatagaaatacaaattatattacaacccttgtcagacaaagataatatatcaaacgataaatttcaggtacaatgtttaaatgttgatgataatactacagtagataaacaattttggataacagttaataaaaatgaaatacaagatcataaacttattgtagttctaaacgatgaaaataatagtaaattaaatcattcttacataccctcaaataatgtacctctctcagaaatgaataacaaaaatatacacaatatgggatacgtcgataataataatataaatcaagatgacccaaatttagcagatggt

SEQ ID NO: 311 - DNA, 1521 bp, Plasmodium falciparum
atgggagataataacacatccagcggtagtagtcccgttttgtcagtaggtaatattcgaggttttggtggaagtgactttgggtcttttaggatgtcgaatgaatttttgggttggaaaaataaaaagacaaataatgtatatcagtataagtgtagtgatattgatgaaggttgttggattaaaactagctataataataatagattacatttaaaattaggtgaatcaaaagagaatattataatatattttgatggatttccagatagaaatgtgaatgaaataacgcaacatttccaaaaatattttaatataagattaaataatagaaagatagcaacgaaaggatggaactggggagaatttaaattagaaaattctaatttgtgttttgatatagataataaatatgcttttaatttacctacgaataatattaatcagttaaatgtacaaattaaaacagatattgctatggaatttaaaaatgatgaaaataataataaaggtaatgaagatttcttagctgaaatacgtttttattatccacatgaaaatgatgaaaatcaaaacttccagaatttaaaaaatgatttattagaaaaagtaaatataggagataccaaaagtgaaagtattgcttctctatctaatatacctctattagtaccaagaggtagatatgatattgaaatgtattccagcacatttaaattacatggaaaatcttatgattttaatatacaatatactaatattaataaaatgattttagtaccaaaaagtaattctaatcaatatgttttaatattcagtttaagtaataaaatgaaacaaggacaaactgaatatccttttattttaatacaattaaataatgatgatgatatggaattagatataagtgctagtgacgaagttatgacaaaatataaacttgaaaaaactatttcaggaaaagctcatgatgttgtaaccaaactttttactgccttagttaataaaaatgttattgttccaggagattatcgaacttctaaaaaccagcatggtattacttgcagttatagagctgcaagtggtcaactttatccattaaataaatatttcctatttattgtgaaaccggttattcttatttcttttgatgatattgtaacactcagtttccagagaacaggaaatattaatcaacaccgtttcttttctcttattattaaacacaaaagaggaatgagctatgaatacactaatattgataaaagcgagtataatccattacttacctttttgaaaagcaaaaatattaatatacaagatgatgccaatgatttggagaaaaaacaagatttccataatgaattggatgaatccgatgaagaagaatatgttgcagatgatgacgacgatgaagaggattatgttgctgaggaggaagacgaagatgatgatggcgatgatgacgatgatgatgaggaggaagaagaagaagaagaggaagaagatgatgataaatag

SEQ ID NO: 312 - DNA, 2580 bp, Plasmodium falciparum
ttgaaaaaaaaaaaacattatcttaatgaattatattccttaaatttcttatcatcatcaactaaggataatagatttgttactttttgtgcactcttattatttgaacatttcagagaatatgttaaagtaaaatatattaaaaaaaagaaacatataatgagaaagaaaaaaagaagaaaggaaatattaaaaaaatcagcaactatatttaatacacttaagggtaaatctattgatgaattaattaaaatgagaattatacaaacacaagaaacatataataatatcgatacaaataatgctatcatcgattcagaagctatgcacaaagatgatgatataattgaatactcaagttcattatatgaaaatagatcatttcttactagtgaaaatgctgctgaaaggggttcgagtattaagagtaattcttataatcctgatacgcatgataataaaatgcaaatgaataatagtaacatagatatgaacttgtcaaatattagttataatcatgatgaacttgaaaataataaaagcttaatcaatatccatagtaattttactacggaagagtcatgtgacgacatgaatgaaaatgaaaaggacataaaaaaaaagaagaaacatacaaaaggacatacctctaaaaaagaaggaaaattcggtaaaatggacgaagacgaaatagatgtagaacaagaaaataataatgataattgtaatgatgtagatgtaatgaaacaggaaaataaaatgttaaatggtattgttgatgaaaaaatatcagcaaatgatcaaaaaaaaaataataaaaatagttctaatatacataaaaatatatctgatgatcattcagtcttaaataataactccaaaaattctgttgctcattatgagagaaatgatgaaggcaaaaaaatagacaaaaaagataatactgaaaataatattattaataatattgatgatgataatattcacaacaactacacaaatgaagaaatatctaaaaaggagagtgatttacataaaatagataatcatcataaaaaaaaaaagcatcatcatcatatgaaagcaagtgaaattatttcatccgttgctcataatttttcgaaaaagcattttaaacatagtactaaaaataatttaatggaagatgaatattttgtaaaatcaatggctaaatttgtaagatataatccatttttagataaagaatttgtaggtgaatatatttcacataggaaaaatgtaaacctattaaaacgttatgtaagattgtttgatttttgtaatttatcgttattatcatctttaagattatttttacgttgttttaaattacctggggaagctcaattaatagagagaatattagaacactttagtttatgtttcttttattctaatccaatacatggtgatttaagtaacatatataaagtagaaaatgataaggtggtttgtttggtaaatgacgaagaactagctaataaaaagaggtacatattaatagattttttaaatgaaaatagtaataaaaataatgtaacgcatgatgatagtgtattaccaaatggtaatgaaacggacgcgaaaaaaaatgtggatgagaataataatgaaaatgattctaatttaaatgaaaatagtacaaatctgaaaaaaaataatgtagataataataaagataatgtgaatgatttacatattgaagaaaaaattaatttaaaaaagaatgtagatattaatgattatatgcataaaaatgtatattacttatcaaaaaaaattgaaagtatgagtgaagaggaaattcaaaagaagtatgtacttgttgaaaatagtgatgttatttttatattgacatattctataatcatgttgaatacagatttacataataatcaagttaagaataaaatgaaattagaagaatttattaaaaataatagaggaataaataatggaaaaaatattgatagaatatatttagaaaatctatataattgtattttaaatgaagaaatcaaattattttcaaatacacaaaacacatatacaaatgacgatcagtattggaaattattagatcaaaaaaaagaagaatataaatattatcattattttaaagctaatgaaatatatttttatagatatgatataaacaaattgttaataagaaataatttcctacctatattttttgaactctttaaacgaacgaatgattacaatttaatcgaaaactgtacatttatgtttaaaatggttataaataatttggcatattatcatgatttaggaaatataaataaaatatgttatatatttaaatatataaatttttatttaacacaaaaatgtcaatctttattatatttatttttccatttcataaaaaaatgttataattcgtttcgaaactgttggtctatttatattaatattatatttaaattagttactattgatttattgcctatctttttttatccacatatatttataaacaatactcagtttaacattgataaagatgttttaaatagaaagtctaagaaaggaaat

SEQ ID NO: 313 - DNA, 1779 bp, Plasmodium falciparum
gataatgattctgaagatataaaaaatacaaactttaatgtaaaccataaagtaatacaaaaaagctttattaataaacaagaattatctgatgaaaatatcgttaaaaatgaattatacggaaatgaagatttgtatgattatgaaactgacgaatattatgttaatgaaaataatgataataacgatttgagtgataatcaatctagtcaaagtgatttttatgaggaaaagtttccagaagatatggtaaatataaatgatgaaaaaataaaaaatgagctatgtacatatagtttaaacaattcaaataaattccttcattccaattctaattacgtaagtagaaaaaaggaggatgatttacaaattaaaaaaaataaaattataaaaatatatccgaaatatcaaaagttatataatgatacggatacacctatttctatattaataaatccgcagtttgcatcattttttaaaattgaattatttttatttataaaaggatattcaaaagaagaaaaggttgttatatatttgaaaagtataacaccagaaatatatatatcaaacagcatacatgatatagatacaattcttataaatacttgtaaaaccttacattttgatcttagcaataatcatccaattgatgcctctattaccatagaaaattcagatgattactataaggaatataagatagaaactaaaaaatttattatacctgcaaattctaagtatttacttattattgtatatttacctacaagacatggtccttttgaaaagacatttataattcatcaaaaatatacaaatgttaaaaaaaatataaaacttttaggtacttgtatacttccagatcttaaatttgatatagatgaaataaattttaatgaagtatcacatagttttttatatgaaaaaagttttcatattattaataattctcacttaactttaaattattcatttaaatattctaatgaattaaatgaagaaattcaaattataaaaccatttggtgaattacaaaaatatgaaaaagaacaagttgttataaaattttgtcctaaatatataaaaacatatttttataatatagaattttttatagaggaaattaaaacatataaaattaagttaccattccatgctatttgttctaaacctttagttttgtgtgaacctctttttttaaaccttgaacatattattattgatcaaatatatacagaaaaaataaaaataattaatgaatcacaagaaactgatataaaatatgaattcataatagaagaaaaaataaaagatatttgttctttccaagtttgtgagaatgaaggaataatacaaagaaattcttttaaatctattggtatatctttaaaaagtaatagtataggaaatatattaattgttataaaaattaaaattcctggtttggatgatttcttattttttaatataaaagctttttgtacttgtccatatataaaaataattccaaacattatcgattttgaaaaatgcaactgtttagatgttaaacaaaagattattgaaataaaaaatgaaagtcctattagtacatttattactttgtctaatgaaaattcggtgtttacatattctgataataatttctacgtacagccaaataagtctatttttataaatgtatatgcacaatgcttagaaacaataacatataatgatatattaattgtgactgttcatcgaaaggatgacatacatataccaataagggctcag

SEQ ID NO: 314 - DNA, 2325 bp, Plasmodium falciparum
ggtataggatcaccaatatttatccatgaggaagtcattaattttgatatagttaacacgagcaaaaaatatttccacgaactaatcatttttaataaaggtatgaacgaaagaaatatatattttgtatttgaatcagaaaaaaatagaaagagaaaaagtgaacaagtacaaatatttaacatcacaccaaaaaatttgtcaattaaaggaggaagtaatattgtgtgtattttaaattgttttaatattaaggaagaaaaatgtgaagatatactttatatatatgatgatattgcaaaaaacaaaaaaaaagcattacataattataaaaaaataaatatcgtagctacatttgttcatccggaggttgagttaagtgaagtggaaaattttgtttataattttaatgattatcatgatatagatgaaataggaagaattgaaaaaagatataaaaaggatattaataaaaagaaaaaatatataaacgacaaaataaatgaaaatgtgaacgacaaaatagatgaaaatgtgaacgacaaaataaatgaaaatgtgaacgacaaaatagatgaaaatgtcaacgacaaaataaatgaaaatgtgaacgacaaaatagatgaaaatgtcaacgacaaaataaatgaaaatgtcaacgacaaaataaatgaaaatatgtacgacaaaataaatgaaaatatgtacgacaaaataaataatgatatatataatttgaataacaaaaattctcaacaaaaaaaaatgattcttataaaagataaaaaacaattaatgcaagaggttgaaattcgaaatttaaaaaatgctaatattaaatttgctttgtctattaaagatccatttttcgtacaatctgatataatagaattgaagggtaaggagaaaaagaaagtaccgatatattttgacataaattatatgaataataaattaaatactacatatcaagaaaatttgataataaattattttgaaaacagtagaagacaaaagtatgaattagtaggacaaactatataccctaatattattatgaacaaaagttgtatagattttcaatatattttacaaaacttatatgctcaagaatttgtcgaaataacgaatgtatgtgattataaaatatattttaaatggttttttgaagataatagtttgtataaagattttaatgaagtttttgatataaaccctaatagaggttatttattaccacatgaaaaaaaaataataaaaataacatataatagtattaatgaaaattattataatattactatattatgtcaaataaaaaatggacctatgtatccattaaaaataattgctggttattcagaaataaaatatagtataaataaaaagatacttgaatataatatacattataaaacaataggagaagatattataacattacaaaatattgggaaaataaaattatttattgaaattatttataatataaaatttccatctttattatatacaaatatcaataatttctttattgaaccaaacaatagtagagacatcattttttattttattccaggaatccctatagatataatagacaatatattaattaaaatttgtaattttgaagaaataaaaataaaattgaaatcaacgaattcatgtaatattttatatttaaacataaaccaatttgataatcatcaatcaattataaaagatgaaatttatttattacaagatgttgataatatgcaggatttggatacaacgtttcattctaagatgaaaaatgattctataaataaaaagaataactttaaaaacataaacaatttattaaaaaataatttccatttatatgataatgtgcaaaatgattattatgaaaaggaaaggagctgtctaattaaaaaattgaaaaacatgtattcagatattttttcatcattaagaaagtatatccaagaaatattagatatatattacagtataattagaaataataaaaatagtgatgatcataatgatgatcataatgatgatgataaggacaaaatggaagatataaatcttatgaataaaaaagacaatacaaaaaatgaaaaaatgtttataagaagtagtattatacatactaatgaaaaggattcaaagaataatatgaaatgtaaatatcacttgatacctattttaaaaaattacactttaaaaaacaattcaaattgtgctatatttcttgatttgttaaaagctttaattttgaatcacaaggatgataattatattctggaactattcacaaagcttaaaaaattaatc

SEQ ID NO: 315 - DNA, 939 bp, Plasmodium falciparum
caaatgaacaagagacctaggattggaaatatgaacgacatgaaaagtggtaatataaattcgaccattgagttaaataaattaataaaagattattctgagaaaaaaatgttaaatcagttacctaacgacaatacaacaaatgaagctgaacaaattatacaaacattattaaataatatgatgaataataaaccagcaaggataaaattatatttatgtgatcatttaagaacatgtgcaaaacatgtatttaataggccttcaatatatataagtaataataacggaatggaaaatagtacaaatcaaaatatgtatcaaaataataataataataataataatagtaatggtgaatcattattatataattcatcagataaaataaataataatgatatatcattaaataatcaagatattttttctcttcctcaagaaaaaagtatacataataataaacctaatgtatcaacaaataacaatgaatatatttggaaaggtatcttaagtatgaagaataaagaaaatttgaatattattgggcatgcattacaaggaaatgtaaacatttttttaaatgctcacattacaaatattgtaataagtcataggaaaaggatgaaaagtatacctcaaatggaagctatatattattttgaaatcgaaaataaacaagatgaaaatatttttgattcttataaaaattattttaatacgaaagatagagttggattagtatcaacaaatgaaaattggcatttatatataatatttccaggaagtccgatatttaatcaattctgtaataataataatttagataatatatttataggtattgtatgttataatcctcaaatcgtagacaagagaagtgctttatcttttgcgggacaaaatatggatgcatcaaacaattataaccaaggagat

SEQ ID NO: 316 - DNA, 1023 bp, Plasmodium falciparum
atgagaggatttaattacaacaacaatagtaataataataatagatatagtgcttaccccgattataataatagttatggaaactaccaagcatatggtcaacaatatagagcgaattatggaacagggtatgttccaaattacaataataattctaataattatggtaaaaatttagctccaattgattggaaaactataaatttagttccgtttgaaaagaatttttataaagaacatgaagatataagtaaattatcaacaaaagaagttaaagaaattagagataaacataaaattacaatattagaaggtgagaatgtacccaaacctgtcgtgtcaattaataaaataggatttccagattatgttataaaatccttaaaaaataataatattgtagctccaacacccatacaaatacaaggatggcctattgcattatcaggaaaagatatgataggtaaagcagaaacaggtagtgggaaaacattagcttttatattacctgcatttgttcatattttagctcaaccaaatttaaaatatggagatggacctatagttctagtattagcaccaacaagagaattagctgaacaaatacgtcaagaatgtatcaaattttctaccgaatcgaaaataagaaatacttgtgcatatggaggagtaccaaaaagtgggcaaatatatgctttaaaacaaggtgtacatattttaattgcatgcccaggtcgtctaatagatttattagaacaaaatgttacaaaccttatgagagttacttatcttgttttagatgaagctgataaaatgttagatatgggatttgaattacaaataagaaaaattgttgatcaaattagacctgatagacaaactttaatgtggtcagctacatggccaaaagaagtacaagccttggcaaaagacttatgtaaagagcaaccaatacaagtaaatgttggctctttaacattaactgcatgccgtagtattaaacaagaaatatatcttcttgag

SEQ ID NO: 317 - DNA, 3009 bp, Plasmodium falciparum
atggctgatgaaaccaaaatagggaaagaagaattaagggtgtggatagaggatacattgaaaagaaaagatttttcctttaattgtttgaaagacggtgatatatatttacaactgtttgaatatatatggccaaaagtgatgaaaaaatataaaggacgtattataatgtatccatcaagtgataatgaaagaaaagaaaattggaaagtaataaatattgtattgaagaaggtacaacttgaagaagattttattaagtataatgatattgttaaaaataattttaaaccatgttatgaatcattaattattttatattttttatattctttagtgagatatcatgaatgtgattttatattagcacatccgattgatcaaaaattaactgattttatgtctagtgagaaacctctaacatgcttggttaaagcaggtagtgttaatctcccaaaaaatgtatttgaaaattttgggaatatgtctcaatgggaagatctacatgtaatagatgatgacaagggggaaaatgatgacaggggaaaaaatgatgacgggggaaaaaatgatgacaaggaaaaaaatgatgacaaggaaaaaaattatgacaagggaaaaaatgatgacaaggaaaaaaattataacaagggaaaaaatgatgacaaggaaaaaaatgatgacaaggaaaaaaatgatgacaaggaaaaaaatgatgacatatataatgaaatgtataaccaattcaataatatattaagtacttctcataaaaaattagatatgcaaaataacgtatcttttaaaaaagatgatataaaaaaggatagttcaatggaacacttaaatttgatctatcctataaattctcatatggaaaatacctttgataaatatataaaaaattgtgaaacctatacaattgatcataacaaagaagaacaacaaaatatgatggaccccattgattcaaatagtaacatcaaaatggaggaagtatcaaaggaatacaagaaaaaaaaaatttttttagaaatgaataaggaaaatagtgaagaattagatactagagtaaatagaaattatacaaaggaagaaataaaatatgataaaaaatatgatcaaagtgatactgttgtaggatatgaaaaatgtgtaaatgatgataccatatcttataataaacattttagtgataatatattgagtgaagttacttggaatcgtttttcttccaacatttcttgttatgatgataataaattatataacaaaggtttgcataataatatgtccaatatatataatgataatatggatataaaaacaaagaattcaaaggaatttcatataaatgggataaagagaaagagtgtatcgcacaatttaagtaatatatgcacttctccttgtagtgaattttttaaatattttagattggacgacgagatatttcaagacaataaaacgaaaaataatgtagatatgataaatagtaaggaggatctattaaaaaatgatttgggtttatataagaaagaaaaatataatatgtgcacatataaatataacagcaacaacaacaacaacaacaacaacaaaaacaacaacaacaacaacaacaacaaaaacaacaacaacaacaaaaacaacaacaacaacaataataataataatgattgttttggaagaaggcctatccatttctttaaacacctcaataaacataaggtagatgtgccatcacaaacagataataatctagaggatatatttttaaacaatataattcatcatgagaatataaaaaatctagaaattatatggaataataatgaacaaaagttgaagggggaatctttaattcttttcttaaaaaatcaaataaaaatgtataaaaaagaattaagtatcaaaaatgatgaaataaaaagtatacaaaatatacacaaaaaaaatatagatgatataatatcatctcatatattagaaatatccaaacttaaggaaaaacaccaagcagatatttttttcataaaaaatcagcacttggaaaatatagtaagtgtaagaaaaaattttgaatcaaaattaaatcatatagaggaagatcttttcttagatttggatatactttataacgaagataatggttatgtaataaatgaacaaattaatcaaataattataggagaacaaaatgaaagagaaaaatatggaacagacgaacacattgataattttctcaataataaggagatcaaaaaatgtgatatgaataataatgtgaacaattctaatgatcatataaataataataataataataataataatgatgatgataaaataaataataataataatgatgatgataatataaataataataataataatgatgataatataaataataataataataataattattgttattattataataatactttaaaatgttcagagagagctaataacataagggatgttaattatttagaaataaaagataacaataatcttatgatatatgaaaaggataagataaaggaacacacaccaaataatgatatactatataataatatttcaaatgaatttattagaaataaggatataccctttaaacatgaagaacataatttgagaaacaatattattattccacatggattagatgataatccacttaagaagctgaaatttttgtggagttacaaaaataaagaacatgaagataacaataaatatataaaagaagaaatgactcaccttaagaaaatatataaccaagtattcttagaaaaaactaaagaatacgttgaactatatgttaacaataaaatattttatgatatattacaatatattgaaaaggacaataatgttgttaaagaagatatattgaaaaaaaataatgaacattattatggtatagaagaaattaagaaaagaatatatgatattatattaaaaaataataatgaaagtaatacatatatg

SEQ ID NO: 318 - DNA, 2763 bp, Plasmodium falciparum
atgaataattatactcctgcagaaaatatttattataataattcaacagaaccatatattaataataatgatatagcttgtaacgataatatgaattatgataataacacgttcgatctttttaattatgaatatacctcttttgataatacctataattcttatcaaaatgaagattattatatggatgacaacacggatattattttttattcgaaagatacagccaagtattatatggacacattaagtaataagcaaaatgatgacgtaggaaaggatgaacaaatattaaatgataacaaaatgttaaatgaaaataaaatattaaatgaaaacaaaatgttaaatgaaaataaaatattaaatgaaaacaaaatgttaaatgaaaacaaaatgttaaatgaaaataaaatattaaatgaaaacaaaatgttaaatgaaaacaaaatgttaaatgaaaacaaaatattaaatgaaaacaaaatgttaaatgaaaacaaaatgttaaatgaaaataaaatattaaatgagaacaaaatattaaatgagaacaaaatattaaatgagaacaaaatattaaatgagaacaaaatattaaatgaaaataaaatattaaatgagaacaaaatattaaatgagaacaaaatattaaatgagaacaaaatattaaatgaaaacgacgttacaaataaaaaccaaagtaatgaagaaaacaatttattaatagaacaagataatgaacaaatttgtaaaaacgaaaagaatagcaatcatataaatgttatacaatttgaagaaaacaaagaatataacaaggaagatgttaaagaaaagttacatgaaaatgaatcatttcataatgaggatgaaacatatacatccagtatctgtgaagaaatgccatcagatttaaatccttataatgaaagacaagaatatgaagaagaaattactaatgataattataaaaatattttatccaatgtatttctacacagaaataagaaaaaaatgatattcgaaaaatatgatgatattagaatattagataatatatcttggaccatcttgttgaagaaatatatttttatcattctatataccatgaaacattgtatcgtatttaatgataaggaagaaaagaaggctgataataaattgggagttgacaaaggtgatctcattaataaatgtaatattatggataaatgtgaacccgttgatgtgtatgataaaaaacgtgaaaacattaagaatgatattgaatgtgttgttacaaaaaatgatgaaaatattacattaagtgatgatattataaagaatgaagaaaatacacataaaaatctgttacataataatttaaatcctaaagatgtaataaataataatatagagaaagaagaagtattatatgatacatttataaaaacaaatgataatactgaaatagtagatgatagattatctttttttaatgataacctagatgtagaagatgacaaatattatcatttcaatatgtctcattgtttaaatggtgaaaaaaataagaaaaatgtttttaacaatttaaattctttatatagtataaatttagataacataaatttagatagtataaatttaaaaaagtataaattaatgtggttacttaatgtgaataaaacctatttaaattataatgaaattattgatctaattcatatttggaatttcttatgtaaagaaaataatacttatgaaatgttaaatgaaacagataaaatgaaaataataatgttctttataaatataatacgagatagtaatatatgtaatgaatttgtaaaaaaaaatattgatactaataaaacatttttaaatctcgatcaattaaataattcagtgaatcatgtattaattaatgaaaagaatgattctaatatgtgtgcaactaataaagaaatcgatacaaataaattattattagttaaatatgaaatgaagaatctttttacaaaaggagaggaagccaatattgtatctaatgtaaataataataaaggaattaataattatgaacctgtcagtataaatcaaaaagagtgtgaaaagatatatatgccgatggaatcgagcttattaaaagaaacaagtgaccatacaaattataaaaatggtggaaatgttaagagtgatagtaataataataataataataataataatagtagtagttgtagtaataataatatttgtattatgcaaaatgaatatttagggaatgatagatatgataataaatattattatcttgcggatatttttggttatataaatagaatatatgtgttatataataataataaaaatataataaatgatgaaaataaaaagttacatacagaacataataataataataataataacaattgttgtaatatctctgtggagataatgaattcttttgtgttttgtcctattcatcaaaacgcaaatacaacaaagctttccaaatataatataaatattggttatattgaaggaatacaaaatattgatctttttattaacaactttgacacatccatatataatgagacaaatttaaaaaaaaaatttatccaaataaaagaaattatacataacgaacaatttaaagttttaaagaagaattttaaaaaagaaaaatgtaatattaaaaaaaaagtcaacgacaaaaattataattgtaatgatttagaaggtaccataaaagatatagatgatgaggaaagt

SEQ ID NO: 319 - DNA, 2229 bp, Plasmodium falciparum
atgttaaaatttttcatattcattttacacatatatttatacatcgattcaatatattcatcagaactaagcaaacatgtaaaacatgatacagatgaattaaaatatgctagtccaacttatgatcccaagaaaggtaccaaggttattttttatatgccaggaaatgagcaaggcgttataccgaataatatacaaaataaacaacatggaacctcaatatatcctgctattgaatatcctactactaaatatcctgctattgaatatcctggtagtgaaatgaataatgggaaaacaggaactactaattcaggaatatataataaagcccatggatcttctaatgattataatgcaagtaattctcaagataaaaccataaatttacatatagatgaaaataattcaaataattcatatcaaccatatgattcaaataatactaataataatactaatagtaataataatagtaataataatagtaataataatagtaataataatagtaataattatagtaataataatagtaatactaatagtaatactaatagtaatactaatagtaataataatactactaattatgatttaaacagtgaatatgaaaaaattagaagaaaagaagaagaagctgcaagaagaatagaaagagaaagaagagcagatataaatagaaaaaatcaagataataattctaacaaatataataatgaacaaaatggaggatatgaatctgatggaaattcacccaatagtagagtaaatataaatataacaaataatggaacacatggtaatccgcataataataattcttatggtcacaaaaataatatgcataatacaactaatggtaattatgctaatggtaattatgctaatggtaattatagtaaaggtgattatactaatggtgattatactaatggtgattataccaacggagattatactaatggtataaataataatatgcatggtaagaataattataatacagctaatggtgaatatgttaatggagcttatgatgggttgaataatggatcatataaattaattggtaatttaaataataaccaaaatgtagataattcttataatcaaggtaatgaaaatgataaaacatacacatccaattacaatataaatcttgaagataataaaaattctccagataataaccaaaattatatatcaacatttaacaaagatataggtccaaataaatctgaaagatcatattatgatgtgtatggaagagaatatgatgataacaaatataatccatataataaaacaaataatcataacacaaatcaaaatggatcgacaacgtatgggtccaatgccaatggaacatacgggcctaatggaacatatggatctaatggaacatacgagcctaatgaatcatatggacctaatggagcatatggacctaatggaacatatggacacaatggaaagtatgggtctaagggaacatacggaaataatgaaactccttattatgtggaacatccagaatatgataatggaaaatctatgtccgattttcatgtaaaagattccaaggataatattggacctgggggagattaccctaatttgtatcaaaacatatatggaaatgaaaaaaatccaaatatttttccaggaagtcctcgtaatataaatgtatattctgttcaccatataccaaataatggtgcaaatggtggtttaaatagtggtgcaaatggtggtttaaataatggtgcaaatgatggtttaaataatggtgcaaatggtggtttaaataatggtgcaaatggtggtttaaataatggtgcaaatggtggtttaaataatggtatgaacaatggtatgaataatggtatgaataatggtatgaataatggtatgaataatggtatgaataatggtatgaataatggtacaaatggtggtttaaataatggtatgaataatggtatgaataatggtatgaataatggtatgaataatggtatacatgatgacttatataatagtgaaaacagtacttttaataacggtctgaataattcaggaagaactggattaaataatgcatatcctcataatggtatgcttaataatggaaccgaatataatgtacattatggaaacagtgattctaataatacgaatgacagtatgctaaatgaaaactattatagtgatagtgactatgat

SEQ ID NO: 320 - DNA, 2229 bp, Plasmodium falciparum
aatacgaatgacagtatgctaaatgaaaactattatagtgatagtgactatgatgatcacaccccagggaacaaaaagaaagtatataaaagtgtagctgaaaggaataaaaaatctgcttctcaagatagtttaggagcaggatttagtgatagtgatagcgatagtgaatacgaagtagtagatggggaaaataaaaaatacaaaaagaagaataaggaaaataatgaaaaagataaatatgaaaataattgggattccaataattataattctgataatgaaattaaagatggttatttaagtgaatctgaaagagaatatgcaagaaataaagcgaatgaaattgaagataaaatgaagaaaggagaatattctcgaaagtataaaaatagtaaatcgaatgaatccggatatgcttcaaaacaaacatccgattcagatgattctgatattgaagcaaatgcattttatgtagataatggacaagaaatgttaataaaagaaaaagaacattattcaagtgattcagaacatcataaggaagaatctgcttctattggaaatttaaatgtattttttcctgctgaaaattatcatttttcaacgtatatgggatttgatagaagatcgtttttaccctctaatgaaattgaattagaaaaaatgattggagcgaacttttcaaatgaagttaaaaattattgtagccgtcaaaatgttgcacaaaaaataggagactatctgaatatatcatttgaatattctagagcattagaagaattaagatctgaaatgatcctagattttaataaacgtaaacatttaacaaataatactgatgacacaattttacacatgatagaaaatgcagagaaaagaaaaaatgatcctaattataaagaagcgtatgaaaataaagattatgcaaataatgctaatatctttatgaatgaatatagtaatccattaagtacaaaatataataaaatattaaaagaatatctttgtcatttatttgttaataatccaggtactaaaccattagagagattatattataatagtttagcattaggagaacttgttgaaccaataagaaataaatttaaaagtttagcatcatccacaattgattttaattatgaaattcatatggcttcggcatctaatatatatttacttgcacatttcttagtattatccttggcatatctttcatataatgaatattttacgacaggaaccaaatcattttattcattaccaaccatacttacagctaattctgataatagttttttcatgttaaatgaaatgtgtaatattcattataatcccaataaaaatttcaaaaaagatataacgtttatacctattgaatcaaggcctaaaagaactacaacattttatggtgagagaagattaacatgtgatttattggaattagtattaaatgctattatgttaattaatattaatgaaataaacaatgtattttctaataataatgtagatggatatgaaaattccttatctttttcacataatgctattagaatattttcgaaagtatgtcctaaaattaataatgacaatgtattaaaatgtgaatttgaagaatcaagtttatataatcctaaaattattaagaatgatacatcagaaaaatcgagtcaaaaaaatttaaaaaaagcatttgatttattaagaacttatgctgaaatagaaggccattcagctgaaggtagcacaagtccatattatgtaagtctaatattagatgatatgaaatataatgatttttataaatatacactttggtatgaacctagagaattaatatatggtgatatcagaggtatgcaaatgaaaaaaaagaagaaaacaaaatatatatataacgattttatgaaaaagagtacccaattaaaaaagaaattaataaaaaatgatttgaaatataatttaaagagtaaaggattagtatttttatatgcaatgattgataaatatggaagtatattaaataaaagtcaaaaagcaaaagttcaatttttaaatagtacttcatctatacgttattatctatatttaaacaaagtaatattcaagtcagcaaaaacctatttagatattatgaaaagagtattagaagaattacaaacgtctaccaatacaccattgaaattccttgttagaggaaattatatagaaaatataaataat

SEQ ID NO: 321 - DNA, 2628 bp, Plasmodium falciparum
aacaattcaaacaaaatatgcaatataagtaacataataaactgcaaccttttgaagaataaggaagacgaatttgttgtggaaaaacaaaatgatcaaaagaacttaaccgatttatataccaataacaataaagatagttgcgtggaagaaggcaagaataaatttaaaaaaacaatttctttttctgatatcaagaataacgatataaataatagtgaatatgaaagtatgggaaacgctataaataaaagtaattttaataatgaaaaaaagaatgaacgaaaaacattcgaggaaaataaaaaggctgtcagtttatcaaaggacaatgatgatttatatcacaaaagagaattagtgaacaaggatttccttgacttattaaataaagctatgaacatattttctaataattttctttttctatatttatatgtctattatattattcattatttttcactttatgatatattattcatatgggagagaaaaaataccaaaaaaaggaaggaatctaaaacgtatcatcaaaagacatattttcaaaatatgtccttaaataatttaatcaacaataatgtttcaacgtctcatacgaataaagaaaatactaaccttttcaatattatgaacaagaaaaaccaaggaaataaaaatctaacaaattgtattaaagaagaaattgataaaatattattttccatgaaaatattagaagatacgaattgtagcgaaaatgatgaaaaaacaatatttggttcattagaaaaaaaaaatacaaaaaatagaagaaaagcaaatactccaaatatatatcaaacgaataaaaagaaaactggacagtggtataacaaattgaattatttaaacaacataaatataagtagtaattataataataataataataataataataataataatacttataaaaataataatgaatatattgatattagtaatataaaattattaccatgttgtatacccatattggttatattatataaatatatacatagaaatatttgttctaaaaaggaaaaaaataattcggacgtatatatatattttcatttacataatttaatgtctgaaataaatataaataaaatcacatgtgaattacataaaaataattgttgtaatgatagtacaaaaaaggatcaattcgatgatagtaattgtttttttatatattcaaaggaaaatgaaaaaataataaataaaaataattttttttatgataaattggaatgtaatacatcctggattaatagtgaggataatgcactatcaacaaaatatcgtgatgatcaccataacaatgtaaaaagaaaaataagtgtaaaaaatatatatttagaaactatggtatggataggtttaagcgaggttttcatatatctaaatgtatgtccaaaacttattatatattttttccatataattaatacctatataaatttttatttaagtttgaataaaaataataatacatataactatgaaaaatgtaattttttttataatttaactcaccaatttatgtgtgtcaagtctctatttcttttttatttatattcaagatgtacaaagaaaaaaatatataataaaagatttaccagaaacagatatgaattaaataatatgcctgaaatattacaaagttataatatatatagtacaaaaaacaacataatactaaacaaagataacatgacgtcgtttaaaaatatatatatgaaaattcttttattcgagagagaagcacagaagtgtaatacatatatggatgtttttgataaccatcaaatattgttagaaaacaatcatatatgtttgcaggatgatcatattccagaatataattttaaattaccatatcgtactatagacaaaagcagaacattgaaatctagattctggccttttaaaactgaaaagaaagaatttaatactataaaaaatgatataaaagatataaataaaaaagataaacctaatgtggtagaaaatgttgaagataaacatatgttatctgatgataataaaaaaaaagaaaagaaaagaaatataaagaaacataaggaattaataaaaaaattacatttagatgaacagaaattatttaattcattattttatcataatagcttcaataaaagacatgaagaatataaaataataaaaaatataaaaatatatttatccttaatgaccaaaatatattataataataggaaggttcaaattttatatgctcgttattattttttaaaagaaaaatatataaaggttataagtatcttatctttacttaatgatcattataaaaaaaaaacatattattttaaaagagacgaaaaaggttatctgacaaatctacaaaaaactagtaacaaatcaaataataaatatttaaataatatcttgttttttcatttaaataatcaatctgattttttatatgaatatttaaatatctatatgtattatcaatcatatatgaaaataaaaaattacaaaaaagctaattattataaaaatatcttaaatactatatttttatattgtccaattataccattccatttcttcccatttataaatctttaa

SEQ ID NO: 322 - DNA, 2067 bp, Plasmodium falciparum
atgaataaactattttttttatgtttccttgtgataattatatattcattaagtatttattattgtaatgataacattttagaaaatgcaaataatgacgattctacaaaagatataaataatattaataaaaattcatcgaataaatcaaagagcgagaaaacaagtaactacaataatgatcaatataatatagacgacgcatataacgaagacgaagagaatgatgaagaagaaggagatgatgatgaaaatgatcatttcgaagtcccaataaattgtagcggtggtaattgctttgattctatggatgatataaataaaataatagataataaaaaaaagaaaatgaaatatcgaagaaggagagggaaagctatacaaattataaaaccaaatgtaaatcatacggaattaattataatagaagaaaatttagaaatatttaaaagaatagataaacctattgctattgtttcagtattaggtgatatgcatacagggaaatcttttttacttaatttattaaatgaacatgtgataccagatattaataaaagtaacaaatatattgaaaatgggttcaaagtaggtaatgatattactgctagtacttatggtatatggatatggtctgaacctataagaattaatgttaagaaattaaaaaagatatatgaatatattaatgaaaactttacaaattttataaaaagttatgaatatgaaaaagatgaatataatgaagaaattattgatttattaaatttatataaaacagatgattggatttcaaatgtcgaagaattaaatttatctgatacagatgaagtcaatttaattttaatggatacacaaggtttaaatagtccaaacgtaaataaaagatatgatgaaatattatatgccctaaccaatttaatatctacagatattatatttttaacgatgaaaatgattaacaataaagatttagaatttatagaaaacataactaaagatgctaacttatttatgttaagagcatatactagatcgagtggttctactttttctattaaaaaaaataattttcataaaattttagatacacttaataataatttagaaaataattctttaatattagaaagtattgcttctaaaaacttaatgtgggttgtacatgatttcagtcaacgtcttgatgtcagaaaaggcaaattatggttagatattttattaaattcggatagaagagatttagatattaaatattggaaaaaaataatttctaataaaagtaaagataaacatgatgcatatacaacaaaaaaacaaaaaatcgcttatttaacatataatgagaattctagttctggtcttttaccaaataacaataataataataataatagtaatgattcgtcatctaattataaattaaatatattatataaaaatatcgattgtgttttattaagaaatatgtatcacaataaagaatttgattttactaaagctaatattaacgatttaaatgaagaatataaaaatgatgttttgttattaagatataaaatatatctaagagctttgttatttcccaaaaaaatgtattctgatgttcaaattaataatattataaataaaattagaaaagaacaaaaattaagagaggaacaagaaaaaaataaagataataagaagaatgataccaataatcagacaaatgacttaaatagtaataaagacgaaacatcagggtcacaagtaactaatcgatttatgtctggtcatgatgtatatgattttattacctttttagtaaagtctgcaaatcaaaacttatttacaaatgtgaatcagttttttaaacattttaaaattaatagagcagaaataagtagaaatgatttaatatttttatataaaaaatatttattacaatttatggaaaatgaagatgttgaatttattagtaatttgaatgatgaaaatgatgatttatttttacaaaaagaaggaaataatacgtcagtaaatcatgatgaaaactcagatgcagattcattatttaatgatcat

SEQ ID NO: 323 - DNA, 2535 bp, Plasmodium falciparum
atggtacgtcaaaaaaaagaagattatttattaaatagtaaaagaaatgatttatatgaaaagcaaacattttcaattagtaatataaatgaaaagacaaaaataaatataaataaagaaaaaaatgataataaaaataatttagaatcccattatgaatatttaagtaatgaaattctgaaatttatgattaaatataatgaaagttcaaaaaattttaaaatggatgtaaatgaaatagatacagaacttttaagtactagcataaaaaaatttgttcgaaatttaacagaaaaagaaatgaatcaattattatgtaacaaggattatattttttcaaaaattattatggaaagtttagaaaataacgaagtcaataaaaatgatacaaatgttacatgtgataataaaactatgacagatgatgaatataatatagataagaataatacagatataaaaaaaaatacagaccctagtcataagaatgataatataaaacatgatttacaattatgtggtagtaaaaccatgtccaatttttataaagagggaaacacaaatgatattgatacatcacgtaataataaatcgtgtgaaaataattctaataatatttacacaaatgtatcaaaaaatatgaataaggaccaaatttttaataataatgttaagaagaataatacatttaatgttaatattaataaaaatgcaccaaataatatgagcaacaacaacaataataataataataataataatgtaacgagttgtataaataataatggaaaaaataaaatgagatcattgaaattgtcaaatgataatgtcagtatgctgtataattattacttagatatatgcagagataataagtcacaattagaaaaaaaaatacaagatgataataagatcaatgaaaagattacaaatgaaaatcttatggaaaatgtaaaggacgtaattaaaaaggaagacaatacacatataaatgatacaaatgatacaaacgatacaaaaagtaataataataataataataataataatagtagtagtagtaataataatcacgtggataagttgaaaaacgtaacatatgatcttaatactatctcgtcgactaaaagaaaaaattttaaagaacatataaattattttttcaatgattgctttaaaaattttaaaaacttaaatgataaaattaaacacaaaaaaatttccgaaaatgttgctaatacgaataatgataaaaaagaagaaaataatggtaacttgaatgaaaaacataaagaacaaaatattgataatgtattgaatactagaaaagtaccatttgatggtcatatattagatgaacagacctcgtgtaatgataaagatgatgataatttagaaagtgaaaaaaagacatttaacaaatgtacaagtgtaacaaagaacgaatctaataatatgatattaagaggtgataaaaataatgatatcataaaaaaaatgagaactaatgatcatacagacagaatgacatttgaacattttaataataagataaataatataattaataaatatgaatataaacaatgtcttaataaatatgaaagacagttaattaaatttgtacagacgtttaagaatactaaacaagatcatatatcttcacaaatatataatgatcataatgataaaaatgatataataaagtacaaatatgatgaagagaatatattaaaagcaattttaaagaatatgatgtgggaaaagtcaaatatgaatagtaataataataataataataataacaattcttcaagtaatgaatcgttcttttcatttaataatagtattaaagatatcgatgataattttgttgaaaatgctgatgatattatatatggtaatattgaccataataataatattaaaaggtcgtatggttctaataatatatatgattataataatcatgatagtagtagtggaagctgtattaaaatatcgagtgataaaatgataagttataaaaataataaaacagatgagaaatattcaaatccaaaaaatatatatccaattaaacaatcatgtagtgatagtaatcattatatattacaaaagattatgaaaaataagagagaaaaaagttgtaataataatgaagaaaataatttctcatttaatgatattttatatgacaaacgttcaaataattatgataatagtattagtatgtcctataataaatgttttcataaaaatataaaaaatattacgaattcgattactaaaaattatttgtattataataataataataataaatatggaaaaagaaatgaaacctttgaacatatatcaaataataattatgggaatcataaaaaaaatgaaaatatattaatgccatctcagtctaagaatttttcttgcttatcttataataaggaaaataattcatttcccattatatgtaatggaaataatgttgatgaaaataaattaaaaaatagttgtgtaggaaatatgattaaa

SEQ ID NO: 324 - DNA, 2118 bp, Plasmodium falciparum
atgacaaaaaaaagaggagatggagttaagagcataagttttgtcctagaaaaggaatcgaataatattatgtttgataaaattaatgaagaacaagatgaaactgaagaagaatctgaaatgaatgtagacgagtcaagtgagaatgagtatcttgaaaatgtatctgaagagaacgaatctggtgataatcaaacaggcgagaatgattccgaggaagaggactcagaagaagatgaggattatgaactaaaaaattatggaatagccctcgagttacctcaacgaaaaaatcgaggtaaaaatatgaagaaacttatcggtgaagatttagaaaaagatgaacaattttggaatgatagcatatgggaagaagaagaaatagatgaagaatatgtgaattcagaaggagaagacgaatatgttgatattacagactccgattttgatgatgatgaagataatgaagaagacgaagaggaagaagttgatgatgatgaacaaaacaaacgtggtgctcgtagacatagtatcgaatatgaagaaaggaaaaataataataaaaaaaattttgcatatttagaaaaattaaaaaaagaaaaacaaaacaaaataatgaaatacaatttaatgaaacaaaaacaaaatgaactaaaaaaaaataaacaattgatttctaataaatcaaaaaaatcagaagatgatgctgaagaagaacaaaaagaagaagtaattaaaacaaaagaacaattaaaagaagaaagaagattaaaaaaaaaaaaaaaactagaacaggcttatttatatttaaatagatctactagagatacaacaagaagaaaaacggaatatatggaaaaagtttttgaaatgagaaaaataaaaaaagagaatcgttttaaaaaatttggtgcaagaagaagagaaaaaaaaaatatgcaaagagaaatgacaagagaagaaagattagaagaagccaaaattacagaacaatataatatccaatccttattacaattacaagcatgggaagaagaaaaaaaaaaatatatagaaaataaaaaagtaatacattataaaccacaaaatgtatttattagttttaaatattcgaaagataacatatttccaactaatgaaaaattaacatatactcaaaatttatatgattattacctatataatgaaaataggacaataaagaatgatataatgaatcaagtaaaaaaagaaataaatgttaatataattaataacaaacaaatagtaaaagttgaacaagaattacataataatcatgaagaaaatataaatagtcaaaagaaaaattcttctatgtcaattaatattccccccccaataattccagataataaagagaaacaaattaataatgataagaacacaattttgtcaaatcgaaatttaaatgataatacaaatgattatccaaatgattatccaaatgattatccaaatgataatacaaaagatgaagaaaaaaatggacttatcttaaatccaatgaatttggagaatttagaccaatgtgaagatttaaatatacaatatctaagtcaaatagatgatataaattttgataatttaaataaaaataaatctaataataataataataataatatattaaattctaataatgaaaatatgtatgatgataataaaaataagtcaaatgtattaaatcaagatattaagaaaaacaaaattttagctattccaaattatgaagagaaacaatattatattgtcaccaatgaaaatgagctaaacatttatagtaattttaatgatcaaaaagataacataaaagaattaaaaaatcaaaaacaagaaaaacaaaaaatttgtgctataaccaatttagaaggtaaatattttgaccccctaacacaacaatattacaataatgcagaggcatttaaaaaattacgtttatattatcatcaaatatcatacaataatttaaataaggatatatgtctaacagtcaaacatttcaaaaacaaattagccgaaatagaacaatacgtaaatagtaataataatcataatagttgtaatgatataccttgtaataataatgtgaaacattaa

SEQ ID NO: 325 - DNA, 2490 bp, Plasmodium falciparum
aatgacaatcgtaagtataatggggaggaggtgaaaggagaaaatgtagaagaagatgaagaagatgaagaagatgaagaagatgacgaagaagaagaagaagaagacgaagaagagggagatgaagacgacgaagagggagatgaagactacgatgaggaaaatgaagaggaagaggaagatgcaaatgaagaggaagaagaagatgcaaatgaagagttagatgagaatgaagaaaatgaagataaagtagaagacccaaatgaggaagattaccgttttgatgtaaataatgatgaagatattaaagataacaataatgctgatataaatagtaggaacaaacataaaaataaaaaaaataataatgataattttaacaaggatgatgatggtcaattacaaaatattacgttagaaaataatgacaaagataaagaatctaataataataataaaaccaatgttgacataaaatcagacaaaataaaatccaatttggatatactaaaaagcaaaaaaaaaaacaaaaaaaggaaaaataaaaaaaagaaaattaatttaaaaaaaaaaaagaaaagttatgaaattaaagaaaataattacgaagattattccgaatttgataatatgaatgataatgatatcgaaaatgaagataaaacaatggatgttataaatccaggtaatgattggataagtgatataaaatggaaagaattattagatatagagaaattaaaaaatttcgaaggatttataaattctttcattaaatctattagagaatggagaagatggtttaattatttacaagtggaaaatcttgtatttccagatgaatgggaatataatttaaatagttttcaaaaattgattataataaaaatattaagaccagatagattaaacaaagcaatagaaaattttattttttctaatatgtcttataatgatatagaggtagaatacatgaattttgaatatatattacgcccttctaaaaaaaatatagaaccattaattattatatacaaacctaattatgatccgtttgaatatatttacaagtatgctttggataataatcaaaagttaaaaaatattactctaacaaattataatataaattatatatataattatttaagggttgcaatgaaagaaggacatgttttatatataacaaatttacacaattctaatgaaaatttattaaaattgacaaagttaattgaagatatattaaatagtaacacaaaatatatatttaatacttctgatgatattaatgtggaagaaaaatatgaaataaaaactatgaatatatcacgagaggatgaatataaacataaagaaaacgtacatagaaagataaatgaggaagaaattgtgttggataaaaatgttgatgatgatattaataacaatgaaatagttaatgaaaaggatagagaatataatgaagcatttagtaccttagataataataaaaaaatatataataccttaatagatgaaaaatataatactatgatgattaaaaattgtttgaaaaagagaaataaattcattactgttcatccaaaatttcgtttattcttgtcaacattaccgggtaaagaaatccctatatcattattacaaaaaagtattattgttattttggaagaaccacataatataaaaaagagtatatctatattatttaaagaacattgggcattagaagaaaacaagaatgttcaatcaaataaatttagaaaattgcttttcagtttattttggtttcattctattttaaataatagaaaaaaatttgataatttaggatggaataatgaagaatattttttcagtaataaagatgtcatcctaagtaaatatataactaaaatattttttaataaaggtgtaaaagaaatacattggccatattattatttctatatttgcgatattatatatggttcaaaaatggatgattattttgataagaaattgttaaatgtatatgccaaagtattttttaataataatatatttaaaggtaaatatatattctctagttcaacaaattattatttacctatagatgtaaataatgaaaagctattaaataattatttaaaagaaattccttataatgatagtgtagaattatttggacaaaaaccatatgcagaaatatcatataatacaggtgcatcagaagaaattatatcattacttttttgtgttaactccttgagtttgaatcagtatcatttccataacaaaaataatataaatataaatgaaaaacttgtatattattttacaaaaaagttactacttaatatgcctcgtgaaatatacgtggatgaattaatgaaaaaacaatataatcctgaacaatatatatatgcaaatctattatttaaggaagtgaataaacataatattattttgaaaaaaataagaagctctcttaataaagtacaatatgct

SEQ ID NO: 326 - DNA, 2352 bp, Plasmodium falciparum
tctgaaagtcaaaaattccgatttatatatcatttttatagtgttagattattaggagttagtccatctgatttatatatgaaaactaataaatttttatctatgtatgatgcatatgtaaggaaaaatgaacgaaatgcagataggataccaatcatgtttaataaatttggtatactacttgaagcacttatttataaatgtattcaatatgatattataaataccgatataagaaataataaaaatgaagcaaaaaatacccaaaatgttggaaatgacggaaatgctgcaaattttgtaaaatcaggaaatgttaaaaatgctgcaaattttgtaaaatctggaaatgttaaaaacgcttcaaattttgtaaaatctggaaatgttaaaaatgctgcaaattttgtaaaatctggaaatgttaaaaacgcttcaaattttgtaaaatctggaaatgttaaaaacgctgcaaattttgtaaaatcaggaaatgttaaaaacgctgcaaattttgtaaaatcggaaaatgttggaaattctagaaatgctgaaattcatgaaagtaatagtcctaatcacaatggggataaaaatgtagatccctctgataacgttacaggaacaaaacaagatgaaaatgaaacaaaaaatgtaatgcaaattagtaatattttatctaattgtatattaagcgaaataatttcaaatatggaaacaatgaagtttcctaataaatattatccatgggataataaaaatgtatttgaaccatttttagaattattatgtatatgtaaggatttaagttgtacaaatacaatgtgttatagatccttaattagatatattaatgttttcattcaaaatactatattaagaatatttgttttaagaaattacaaatttatagataaaacgcgtattgattatttcaaaatacatatgttattaaaattaatctgtacctttaccccttgttataattctcgaattgtcaaaatatcttgcttctttatgattttcataattatgaataagaaaataaatcgatataaacaagattatacaacggattgggacaatcccgattttgaaaaattaaaagaaaaatattacccaagcagtgatccaaaaaaagaaggattgtcaaaaccaaatcacatgtatggagtcccaatagaggtcctacgtttttttataccacactataaacaatgtagaccagaagattttatatactgtcctggatataaaccctatgaaaatgactattataatgtagatggtaccgttcgtattattcgtgatcatatgagatatagtttttatgttgagaatatttgttcaaagaagatgcgtcacaagagaagaaacataagcgcatttaataaaattttatataagaattttaaatcaatcaaaaaacaatttactatgtttcatcgtccaaacatgttaaatttatcttatgattgggattcattccaaaaagatattatggtattagtaaaccaaatattaacctcttacgaatggcatggacatggagcttttgaatcattcgtaagtatatggagatttaagaaaagatattctaagtcctatacatctactaaaagtgttgaggaaaattttagaaatatagaagaagacttagctgatttagatgaagattcaacagaaaatattaatgaacctaatcatttagatggtcaaaataataaaaacaatagaaaaactaataatgataatacattgaaacaaaatcatcgaaaatctaggggcacatctgtacaaggacgcaaaaataaaataaatcggggatcaaaaggcaaacataattctataaatattccaaaagatagaaagacgaacataatgtcacaaattaataaattcatatttaataaaaaagatattaaaataaaatgtgaagaaagtagtagttcaaattatgaagagggaaatagttcgagtaatgaagaaaataatatatcaactgataaaaatataagtaatacaaataataaaaatggagtttcattatatgataattcaaaggtttatttgaaaggagattataaatttagcaaacagtttcataagtacatacacaagaaccttttagataatgtcgataaaacagatagaacaattaatattatatcaaaattcttcggtggtgtgaataagtccaataacgtgaataatattaatagtgtaaataaggagaataacatgaataaggtgaatgctgtacataagataaatgctgtggataaggtaaatgctgtgaataaggtaaattctgtcaataagctaaatgttgtgaataagacgaatgttctg

SEQ ID NO: 327 - DNA, 2352 bp, Plasmodium falciparum
aataaggtaaattctgtcaataagctaaatgttgtgaataagacgaatgttctgagtaagttgaatgctgtgtataaggtgaattctgtacataagatgaatgctgtgaataaggtaaatgctgtaaataaggtgaatgctgtgaataaggtaaatgtcgtgaataagaaggatattctgaataagttgaatgctttgtataagatgaatgctgtgtataaaatgaatgctttgaataaggtgagtgctgtgaataaggtgagtgctgtgaataagatgggtgctgtgaataaggtgtgtgctgtaaatagggtgaatggagtaaacaaggtgaatgaggtgaatgaggtgaatgaagtgaatatggtaaatgaagtaaatgagttaaatgaggtgaataatgtcaatgcagtgaatgaagtgaatagtgtgaacgaggttaatgaaatgaatgaggtgaataaggtgaatgagctaaatgaggtgaatgaagtgaataatgtcaatgaggtgaataatgtgaatgagatgaataatgtgaatgagatgaataatatgaatgagatgaataatgtcaatgtagtgaatgaagtgaataatgtcaatgaggtgaataatgtgaatgagatgaataatgtgaatgagatgaataatatgaatgagatgaataatgtcaatgtagtgaatgaagtgaataatgtaaatgagatgaataatacgaatgagctaaatgaggtgaatgaagtgaataatgtgaatgaggtgaatgatgtcaatgtagtgaacgaagtgaataatgtaaatgagatgaataatatgaatgagctaaatgaggtgaatggggtaaatgaagtgcataatacgaatgagataaatgagatgaataatgtcaatgtagtgaatgaagtgaataatgtaaatgagatgaataatatgaatgagctaaatgaggtgaatgaagtgaataatgtgaatgaggtgaatgatgtcaatgtagtgaacgaagtgaataatgtaaatgagatgaataatatgaatgagctaaatgaggtgaatgaagtgaataatacgaatgagatacatgagatgaataatataaatgaggtgaataatacgaatgaggtgaataatacgaatgagatatatgagatgaataatatgaatgatgtgaataatacgaatgagataaatgtggtgaatgcggttaatgaagtgaataaggtgaatgattcaaataattcaaatgatgcaaatgaaggaaataacgcaaattattcaaatgattcaagcaatacaaataataacacatcaagcagcacaaataactcaaataataatacatcgtgtagttcacagaacaccacaactagcagcgaaaataatgattcattagaaaataaaagaaatgaagaagatgaagatgaagaagacgaccaaaaagatacacaaaaagaaaaaaacaatttagaacaggaagatatgagtccatacgaagatagaaataaaaatgatgaaaaaaatattaatgaacaagataaatttcatttatcaaatgatttgggaaaaatatatgatacatataaccaaggagatgaagttgttgtatctaagaataaggacaaattagaaaagcatttgaatgattacaagagttattattatttatctaaagcaacactcatggacaaaattggagaatcacaaaataataacaactataatgtatgtaattcaaatgaacttggaactaatgaatccataaagacaaattctgatcagaatgataatgtaaaagaaaaaaatgattccaacatatttatgaataatgataattataattcgtcttatgataatgtacataatgataatgataataatatggtatttaaagattcttcaagacaagataatatggagaaacaaaaaagtggagaaaacaagcaatatttaaacaatttcgataataatggtaatgataatgataatgataatgatgataataatgataatgataataataataataataatatgaataatcaatataattatcaagaaaataatattaacacaaattataacattttgtacactccttctaattgccaaatccaaaacaattcatatatgaatacaaatgaaatgtaccaaccattatataatacatatccttcaaatgctattcaagaaaattctactataaataacaacattattaatgtatcaccttacatgaataacgacaacaccactaataacaccttcatttctggtatgaattctaatttaagttctaatatttccaatattaataataacacatactcatatgatttatatagttcaatgaac

SEQ ID NO: 328 - DNA, 1674 bp, Plasmodium falciparum
atgagatttgaaaatcagtttagtaaacatgatatcgttacgtccgccagtggtgtaatagcattattaaatgaagaagaaacaagtttaaagctttttggtctagaaaaattaaatgcaatagtagatgtatattggccagaactcgctgattctatatttaagatagaagaattatgtgaagatgaagattttgttggtagagaattagctaatttattggcaagcaaaatatattttcatttagaaaaatattcagaagctttaaaatatgcattgtgtgctggtaaattatttaatattaaagaaaaatcacaatatgttgagaccatgttagcgaaatgtatagagaaatatgtcgaaatcagagaaatgcaatatgacatagattataacaatcaacataatataaatgatgggattactaataataacgatatttttaatgcatacaataataatgatttagtagaacttaattcacacaatgaacttttaaacaaggaaacagatatattcagatttgatattaataatgaaattaatcaaaaaatggaactacttgttgatgaaatgatagatgtgtgcataaaaagtaatgatattaaagaagctttaggtgttgctttagatgctagacgtttagataaagtagaatatataattgcgaatgcagaaaataaaatagaaattttagctcactcaattaataatgagaaacatataaatatgaacaaatcatttagaaatgagtatttcaaattattagtaaatttatatctttcattaagtgaagaagaattaaaaaccgaatatattaacttatgtgaatgtttatattatatagatgattataagaaagtagctgaaattttattgaagttattacataattatcatttaatggcatatcaaatatcatttgatttagtagattttgaaaataaaatatttctaagaaatatactaggacaaataaaggaaaacttaatacaaaataaagcatattattttggtgaagagtattttgttacaacaccacaagaagaaaataatgatgcagataataaagaaaatgaaagtaatgcaataacgaatgaacaacaagacgaaaataataatgaaaaggaagataaagataataatgatggtaaaaatcctgaacataatgatgataataataaacctaatgataatctaacaaatgatgaacctacctataataataatgatgataaggcaataaatgatggcaatgataatgataataataataataacaatattaataataataataataatattgttgaagatgtattgaaatatatcagtaaaaaacatatattttataataaaatgaaaaaactcttatatatattaacaggaaaagttacaggaaatttatatatagaatttttgcatcgtaataatcatgcagatttaattttattagatacatataaaaatatagtagattcaagaagtagtattactcatcatggaattgttatagcacatgcactaatgcaaacaggaactacttgtgatgtttttcttcgttcaaatattgaatggttatcaaaagcaattaactgggagaaattttcagcaactgcttctttaggtgttgtatataaaggacatgttaacgaatcttttatggttttatct

SEQ ID NO: 329 - DNA, 552 bp, Plasmodium falciparum
gccttgagagaaatatgggatcaatgtaccatcgctgtttacaacaacacattaaatgccgtagaatccaaaccattattatttttacacggtatattaaatgaatgcagaaacaactttgccacaaaattaagacaagatccaagtttaatagtagctaaaattgatcaaataataaaatcacaaatatatcgtttctgggtatcagaaccatacttaaaaattggaagatcacacactttatatacacatataacaccagatgctgtaccacaattaccaaaagaatgtacattaaaacacttatcatcctatatggaagagaaattgaaatctatggaatcaaagaaaaatatagaaagtggaaaatatgagtttgatgtagattctagtgaaactgattctacaaaagacgacggtaaaccagatgacgacgatgatgatgacgataattttgatgatgacgataattttgatgatgataccgttgaagaagaagatgccagtggagatttatttaaaaatgaaaaaaaagatgaaaataaagaataa

SEQ ID NO: 330 - DNA, 747 bp, Plasmodium falciparum
gattcctatcttaaaaattgcaatgaacaattcaacgtcgattttaaaggcgacaatatcgagattgctcacatgatatgcagaatttttcctatggtggattattttgctatttctatgattctgtttattaggtccttcttattagagagtgatgaaaatcattgcttgaagaggctatttaaataccctcctgtagaaaatataaaaattttaatcgatttgtcctttaaaatcaaacatagaaatgagaaaaaagaaaaacatacaaaaaaagaagaacctcatattattcacaataataatttaagtaaaaaagaagatatatttaatttaacatttaacaataataataataatataactcatgaattaaataaacataacataaacaataacataaacaataataatgataggaaaaacgaatataaggataaaaacaaccaccattcaaatgtcaatattttatcttacaacaagatattaccaaatgtacataaaattaataacatagcttatataaataaaaaactattaaaagttattcataatttaaacaatctgtatacatataatatgttaaatgaacaacattataaaattgaattacaacaaaatatatttctcctgaatgaaatttataatgagcttaaaggcatacaacaacactcatatgatgatactgtatcagaaaatatacaattggataagacgaatgatttaccctccatatatttgggttga

SEQ ID NO: 331 - DNA, 2793 bp, Plasmodium falciparum
tatatatgtcgaattataagaaagaaatattccgttttgagaacatgtaatgtgagaaattctcgaattttatctgggcctcgcaaaaattttttttttggatcatgtaatactaataatataataaatgatctggaagaaattttgagggatgaatgggatatcgaagtagataatattttaagagacgatgatactagtacattccatgggaatactagtagttcagagaatagtaattatttatcgataaatgctattcatcgtatacatagaggtgatgatacaaatatttttgaagaaaatgatgtagtttctgtatctgaaatagtggagagtttacatgattctgatgaaattgatcatacagataatattgataatattaatagtatgaataatggccaaaatgaggatgttgattatagtgatgtctcaacatgcgctacagaaagttcattatcaaatcatgatactgaaaattataatgcttcacccaatactagcgatgataacgtgaatgcagatatttcaaatgatcattctaggaatgtagaaaggattcaaaatacgtataatttatttattgtacgtcctaatacatgtcagaattcatatccattaatgataaatatagttaatgaacatggggagccttgtgatcgtcatcctaatattaggaatactgtaggccattatgaaatggaatatataaggcatcaatctagagaagatatgaatacgctttatgaatatgccttaattcgttttcctatttataatgaaaataaagatatgtgttctctagatgaagatatattatacgaaagaaactttctgaaagattttgaattattaaaaagcaaatcttatgatatgtttatagatattcattttaggttacgtaaaggcatacaatgtacagatatgttatctattttttcttttgataataattatggttatggttattattacaataataatttcagtacagatggtgagcaaaacaatagtagggatatgcataacgaacagtctagtttaaatcaagatgtacaggattctttttcaaatggaaatggaacccatacatctgaaaataatggaagagatagagaaagtactaatatttgtatgaatgatcgttgcccttatgataattataatatatttgatagagatcatactggaaacatagaaaaggtattagatcatagtgaaaaggagatagacccctctaaaagtgatataaataaagataaggataaaaaggaaaacaagcaaaatgatagtactgaaggtaaagaggaaaataaagaggaaagtaaggaggaaagtaaagaggaaagtaaagaggaaagtaaagaggaaaataaaaaggaaagtaaagagcaaagtaaagaggaaaataaagaagaaaataaagaagaaaataatgaaaaaaataatgaaaaaaataaagaggaaaataaagaggaaagtaaagaggacaataaagaggaaaataaagaggaaaataaagataacaataaggaggtttgtgagaatagtactggagataaaaaggaaggtaatgaacatgaattaaataataggagtggtaatgtaatcgaagtatataatagaacggatactatatttgataataatgaacaaaatgtaaatgaaataatagggacaagaccagatatgattccaagagaattaaatgtaccttttgataggtatgaagtagatagtttgtgcttatggtcgaatatgtcttcagaatcttctatgaattataattaccgtcctaatttggtacatacacaaaatcaagaatcaagtaatacaagtgtggatatggagattgttccaccatatatgccagatttaattataacggaatcacccactaatacaagcggaacgaattcttcgtacacgattcctcaatattactatagaagagaacaaataaatgatacgaaagaaagtcctgttactgattatgatgatctttattcatctactgattcatatgaaagggatttatcgaatatatcatcttcttcggatgaaagtgaagaaagtgatgtatctgctactactagtgaatctgaagaagctattatatctgtgacaagtagtggatctgtatgtattatgtctgcgactattagtgattgtgaagatacacctataacaacttatagtgaatattctgaaccttccgtacataataggcaacaggaggaatcacaaaataataatagtgtttctaaatcagataaagattcaaactttagagcgtatcatgttgaaataatatacaatgatatcgattttaatttgttacaacattttataaattataatggttataaagatacgcagagacgaaaaaatttagattctctattaaaagcgttagaaaatttaccaaagaaggacaagtcgttgaatgtgtggaagtacggacttaaagtatcattagaaattatagaatatgtttctaacgaaatgtttgctttggcaaaagtcataagagatgattgtaaagatgatggttgtaaatggtgtatggcacatagtaaattcaaaatagatatattaacgttgaatttttttatgggttctaaacgatcgaatccaaatttgtcatataaatatttaactggtaaggaatttatacttacacgcttcaaaaaattagtatatgattcgatagatgctattgaaacatatattgctattgtagaatgtttccttttgggaagtatatttgatacaattaaagattcttag

SEQ ID NO: 332 - DNA, 1557 bp, Plasmodium falciparum
aacgaagcctaccaagttttaggagatattgataaaaaaagatggtacaataaatacggatatgatggaataaaacaagtcaactttatgaatccatccatcttttatttattatctagtttagaaaaatttaaagattttaccggaacaccccaaatagtaactcttttgagattcttttttgaaaagagattatctatgaatgatttagagaataaaagtgaacatttattaaaatttatggaacaatatcaaaaagaaagagaagcacatgtatctgaatatttattaaatatattacaaccatgtatagctggtgattcaaaatggaatgtaccaattataacaaaacttgaaggtttaaaaggatctcgctttgatataccaatattagaatctttaagatggatattcaaacatgtcgctaaaacacatttgaaaaaatcctcaaaatcagctaagaaacttcaacagagaacccaggctaataaacaagaattagcaaatataaataataacctaatgagtacattgaaagaatatgtaggaagtagtgaacaaatgaattcaataacatacaatttcgaaaacatcaattccaatgttgataacggaaaccaatcaaaaaatatttcagatttaagttatacagatcagaaggaaatattagaaaaaattgttagttatatagtagatatttccctttatgatatagagaacacagctttaaatgccgctgaacaattgttgtcagataattcagtagatgaaaaaactcttaaaaagagagctcaatcattaaaaaaattatcatccattatggagagatatgcaggtggtaaaagaaacgataaaaaagcaaaaaaatatgatacccaagatgttgtaggatatattatgcatggaattagcacaattaataaagaaatgaaaaaccaaaatgaaaatgtacccgaacatgtacaacataatgctgaagcaaatgtagaacatgatgctgaagaaaatgtagaacatgatgctgaagaaaatgttgaagaaaatgtagaagaaaatgtagaagaaaatgtagaagaaaatgtagaagaaaatgtagaagaaaatgtagaagaaaatgtagaagaaaatgtagaagaaaatgttgaagaaaatgtagaagaaaatgttgaagaaaatgtagaagaaaatgtagaagaaaatgttgaagaatatgatgaagaaaatgttgaagaagtagaagaaaatgttgaagaatatgatgaagaaaatgttgaagaagtagaagaaaatgtagaagaaaatgtagaagaaaatgtagaagaaaatgttgaagaatatgatgaagaaaatgttgaagaagtagaagaaaatgtagaagaaaatgtagaagaaaatgttgaagaaaatgtagaagaaaatgttgaagaagtagaagaaaatgtagaagaaaatgtagaagaaaatgtagaagagaatgttgaagagaatgttgaagagaatgttgaagaatatgatgaagaaaatgttgaagaacacaatgaagaatatgatgaataa

SEQ ID NO: 333 - DNA, 2460 bp, Plasmodium falciparum
atgctttttaaaaatgaagacagtggcaatggtgtttactgttttacttataataattttagtgatgttactatatctgatattttaaatataaggaatgataataaaaataatgataatgaggataacaaacaagacgatgaagagaaaaacgatgaagatgacaataaaagtaatttgtttttagaagaaaatgaagagaataaaagacaaggagacaaaccatttgaggatttatctttattttcatttaaaaataatgaacagtgttatgataatataaaaatgcaacaagccattttgaattcatcttatgaaaaaaatgtaaaaaatatagttaagatagtatatcatgaggattgtaaattgttatatgaaaatacagatatacacgttgaacttccatctatagtatatggtagaaataggaacaaaaataatgatgtcgtaaataaatgtaatcaatataatgatgatgattatacaaataaatgcaatcaatataatgatgatgattatacaaataaatgcaatcaatataatgatgatgattatacaaataaatgtaatcaatataatgataatgattatacgaataaatgtaatcaatataatgataatgattatacgaataaatgtaatcaatacaatgatgttagaaaaattacaaatttaaaatattttattaatcataactggaaaaatataaatttgattaatgaaaaattatttttgaaaaatttaaaggaactcgaagaaatactaaattataattttttgcatatatgtaaaaataaatgtaaacaatataataagaaaagaaaaaatgaaagacatttctcttatcacgataattttcttagtcattatataatctataaaaaaaataaatttataaaacacaataaaaatgaacatatcaatggtaatcattatgatgctcatgagagtactaacacatacgatgaagagaaaacaagagaaaaacataataataaaaataataatatgaagtattgtctaaataaatatccatatgataatgtgaacgcacctttgaatttatcttgtccatggtacgaaaagaaaatagaaaatatatactgcctaaatataccaggatataaatataaatataaatatatttgcccctcaatgagcaaaatgaatgatgaaaaaataaaagaattatatataccaaaaggacatatattatttaattcaaaattcgaatctgggaatttaaaatatgtaataaaggaagaaaatgacaaagaagtgtattccttattcctcaatccggatatacgaatgaacgagaaaaaaaaccagtggttctatttcagtgctagttatgttccaaatgaatattatacgaatgagttatataaaatgaaaatgtgtaataaagatattaatcatataggggataatatgaacgttgtgtataattacatgaacggtacaggtaataatataaacaatattgtaaataatttggatagcactgtaaattatatgaacagtacaggtaataatataaacaatattgtaaataatttggatagcactgtaaattacatgaacagtacaggtaataatataaacaatattgtaaataatttggatagcactgtaaattacatgaacagtacaggtaataatataaacaatattgtaaataatttggatagcactgtaaattacatgaacagtacaggaaattacctaaatagaaagaataataatcaccttagctatactaattggagtggacaaaggtgtatgaatcaatatttgaatgacataaataatgacgaaatagatacgaatttagatgggaatagaaaatattcgttagacgcatgtgataaatttactgttagaaatgtaaggaagttagagaaaccatttactgttagatttaaaatagaaaatatggccaagcctttttttttatataaatatggtcattcgcctttatccttttcagaatgtaagtataaaatagagaatatacaatgggaaagaaattcatatgatataaaatatataaaaaacagttcatgtaagcattataatataaaaaaaaatagtatggaatattataattataatacgtatacattagaatttagttatgattttacgtatgcatatgatacagtatactttgcaagtagttatccatatacgtattcttatttgagtgaatatttatgtttgataagaaatttgttgaaggatcaccctacaattaattatatagaagaaaggttgtgcaaaacatcatgtgggtttgattgcccagttttatgtataacaaattatgataggatggaagaatataataaagaagaattaaaagaaagtgtagaaaaaaaacaaaacattgtcgaagcgaacaatacatgtgatgaaaaattggttgatgggatggatataagtagtaatgctata

SEQ ID NO: 334 - DNA, 1095 bp, Plasmodium falciparum
ggatcgaagaaacgtggtgcagatcattctgaaacattccttaatctagatgatatgtacgaaaatacaaagtcgtacaaagcgataagcgaattattaattagttatataaaggataagaatagttgctcatttatttatatagatatgaatagtatatatccaaattttgtagatgtagtagagaaagaattaaaaataaaaaattatttggtgggtagtttaattatagcttacaattttttaaaaaagaatgggaatatgataatacgtttaagtagtgttcttacattttttacggcagggttaatttatattttattttgttcatttgataaaatagagttctttgttccaccttcatgtgatgatattagtttggatatatttttatattgtcacaactttaatgaaaattatatatatcgtcattatatacaatttatatgggatgctttaatatgtaataaacatattgatgaaaaattgtttaatatggatgaaaagaagaaattagataagcctataaataaaaaaagaaaagccgatctctatttttctgttcctatgtattatttaatgaataaacattttgtaatgtttttaaaaaaattcaattctttttattttaaacaccatattaatgtatgcttgaattttatgaaggagccaaaatatttctatcataataaaattttgataaaatctttgctgacccatttttttaaggcatatgttattcaggggaaaacatttgaaaatgtatataagtccataggaatgagttttgataatttttatgaaggaagagaagatagtgatgatgaagatgaagaggacgacgaagacgaagaaaataaaaaggaacaggaacaggaagaagaagaagagcaagaagaggaaaaagaaaaaacacatgaagcatatgatgaagagaaaagttttaaagcttttttgcatttaaatagaaaagaatcacatgcgaaaaaccaatttgaattttattcgagcgattctaattattcaataatgtgtgaatataaaaatgtgccgagtgaaatatctatatctgagtctgcatgggacagttcctag

SEQ ID NO: 335 - DNA, 2181 bp, Plasmodium falciparum
atggatgataaaaagaaacatcacaagaaaaagaaagtaggtaagaagagcaaaaaaaaaaagattaacaagaatggaaacaataaaaaatatcataaagcttttgcatttagtggaggtataaaaagtgctcatagaagaaaacaacatttatttgaattagaagaaaaaaagttaagagtacaaaaagtttataaagaaggtaataagagtagccctttaattgtagtaattcaaggtgctaaaggtgttggtaaaagtactttattaaaaagtttaataaaatattatgtaggaataacaataaataatattaaaggacctatatctatttttacaaaaaatttaaaaagatatacatttatcgaagttaacgatgatatattacatatgatagatgttgcaaaaattgctgatatatgtatacttgttatcgatggaagttatggtatagaattagaaactctggaatttttaaatattttatacacgcatggacttcctaaagttttaggtgttgttactcatttagataaatttaaagatagtaaaagcatacgaaaaagaaaaaaaaaactaaataaaaggtactcagaagaattagtcgaaggatccaaactattttttctaagcggtatacaaaataatagatataataaaacagaaataagaaatttatgtaaatttttatcggtaatcaaaaaacccatcatttcgtggagagaacaacatggatatatattagggttgaaattagatgtagacgatcttttaattaataatcaaattacatctcaaaaaaataatcttcaaagtgaacatgttcacaatgaaaattatgtgaatcacgcatcttatgataatgataatgataatgatgaagaaaatgaaaaaaaactcaccaactttttaacaaattgtgatgaaaaaattaaaatatctattgaaggatatgtttatggaagtaaaatttataaaaatcaaaaagtacacattcctaatattggggatgttgaaattgataacatacaaatcttacaggaaccttttaaattagatgaacaaaaaaagaacccaaatatttatgctcctatgtcagatgtggggaatctaacatttgattttgataacatgtatattcatataccaaagaataaagtcaattttaccagagaagaatttttgttggctgaccaaagagaggaaacaattccaggggatcacagcggcgaaaagaatggtaatacattgaaggatgatgaaggaggtggtgatggagatgatgacgatgatgatgtaggtgatgataacgttgatgatggagatgatgacgatgatgatgtaggtgatgataacgttgatgatgatgatggtaacgatgatgatgacgatgataacgatgacgatgataacgatgacgatgataacgatgacgatgataacgatgacgatgatgatgacgataatgagaattctgataaatcctcccatcataataaacaaagtaatgataatgaaaaatacatcacagatagcataaaaatgataagagaattacaaaaatcgaatggtgttttttcaaaacaacaaaaagataatttgattctttttaatgaaacgaatgacaataatggcgcatccaatataaggaggaaagccccatcgaatgtttacatcagtgaaaaacagaaaaagaaaaaacagcaagatagttatgttaatgaaaaggcagaagaatataataaattggaatcaattctttatgagaaaaaaaacaatgacgaagaatattattgtgcaaataatgtaaccatttcttctgatgatgataaagaggaaaatgatgcttcctttagagagttttacagaaagtatggattaaacgctgatatgtctgatgacggtgggaataatgatataaatatatataatggtcaagaaagcgaggagaaattaaaagatacatatgataagcttattgatggggggcacgacgaagatgactatgatgatgatgaaaatgttggtgatgaaaatgacgatgatgaggaaaatgatgatgatgaaaatgacgatgatgaggaaaatgatgatgatgaaaatgacgatgatgaggaaaatgatgatgatgatgatgaaaatgatgatgatgatgaaaatgatgatgatgatgaaaatgat

SEQ ID NO: 336 - DNA, 2259 bp, Plasmodium falciparum
atggaatcctatataagggaaagtaaaaagcttacccttaaaagtaataaggggaagaagctactaagatatttagatatatctttaaataataaatcattacatgatagtcatatattagaactagtaaaaatattgaagaagataataaagatagtatataatacatactattgtttaaatattgatttaagtgaaaattatataacatgtataggattaaaaacattgttaaaatatatattaaattataatgagaatataggagtaaatatattaaaattatataaaaatagtataaaagatgatggggcattattaattaagcagcttgtatatatacagaaaatccccatggaagagttacatttatcacataatttaatacaagacaatgcatgcaaagaattattattaagttttgttcaggcaaaaaaggatagcacatatgtatatccaagatatgataaatatcagaatccatataagcatgctcaaatacctgtatggatacgtttagaatataattgtattcataatcctaaagatatattaaaagaagtagaagattgtgcaaagaaaaaaagaggttacaaaagtaatttaattgtatgctcagctttaaaaagtgataaacgatgttgtccatacaaatgcttaaatgcatctattcgtaatactcccattatgcatgtgtatatgtttattcatcaaaaagaaaatattgtgaacggtaaaatgaaagaagagaaaaacgatttcgtttctctggaaggtgtcctagataaaaatgaaaagagcaactttaataatgataagaatgctgatgagaatatgataaaattggatagcagtaaattaggaaataagaataaatttaagaatgaaaatgatgaatttgaagaagaagaagaagaaatagatgttgacgatgttgatgacgttgacgatgttgatgacgttgacgatgttgacgatgttgacgatgttgacgatgatgaagatgatgaagatgatgaggatgacgaagatgatgatgaagatgatgatgaagatgatgatgatgatgaagatgaagatgatgatgatgatgaagatgaagatgatgacgaagatgacgacgatgacgaggattatgacgatgatgatgacgaggattatgacgaagatgaagatgatgatgatgagaattacaatttgaaggataaaaataatttgaaaggttttgaaaataataagaggataaaaggtaacaagaaaggttctgagaaaccatttgttgttaataaagaaatggttgttgaaaataagaataagaatataaataatgaggaggatgaaaaaaatattgataaaaagaaaagtatgaataagaaaaagaggaagaagaagaagaagcgtgtgaataattacaacaataataataacatcaataataataataataataatagtaataataagaagaaaagtaatttggttaaagataagaagaatagtagtaccagtacatgtaataaatttatgaataatactcataatttaaataaaagttttagtaatatagcctctgatatgtataataaggatacaaatatgagttcattaaataccagtgaaaatactttacctttatatataatattggattgttctgctgtattagatatgaaagaattatggaaggataagtcgattttaccatttagttttccaggtttattatatttatataataataaattattgaaggctaatacaattggtaataataatattcatatgaatagtaataataataacaataataataataataataataataacaataataataataataataacaataataataataataataataataataataataataataataataataataatagtagtagtggtaataataatactaataaaccagggaacgataatttcatatgtcttatgtgtagttatgtagcaaatgaattgaaaatggtttgtcaaaagagcgagataataagacaaaaaatgattaacttgaaattaaatatttgggataaactttctgaattaggaattattgaatttttaagtgtgcctaaagattttaaagaaaataaaaagaactttttaaattcttcttttttaacagatgaacagataaagctagctaatgaatattatgatatatcatatgaaaccctacagatgatacaattttctattgtatggtcaacatatatttttaaaattagtaat

SEQ ID NO: 337 - DNA, 2259 bp, Plasmodium falciparum
cagatgatacaattttctattgtatggtcaacatatatttttaaaattagtaataaagagattattatagaaaataataaaaaagaaataaataaatcggatatgaagaaaagtaaaaagacgatttttacagaggttttgtatttaacatcttcttcgaatatttattctttttttgaatatttatatgaacaagatattaattttatattaccattatgtgtaaccgttaatcaaattaataaatatatacaagatgagcacagttatattatagatattttgatgaataatgcgaaagcggataaatatggcaaattacaatttaataaatcattttttcaacagtttataaaagaaaaatattcaaagtatttgtatactaatacaaaggaagaaataataaatgataagaagaaacaaagtaaaagcactttatgcaacaccaaaccgttgtcatgtgatattttagaacaggtgaatgaagaacaacagatgtttaatagtattaagaataaggatggtatattatcatcccaaaataatttacaaaataataatggaagtgaatatttgatagatgatggcatgggaacaatgcggatatcagatgatatgttgaataattcgaatgacataaagaagaagaagaataataataataaaaaattttcatcagtacaacagatggttgataataaatctgtagctcaaccgattctttcacataataataataataataataatgtgaacagtattaataataataacaatagttacgatatttatgatattatatctgtaaaatctttttcaaatgacaatgtaaacaacatgtgtaatgttgataaaatgatgaacgttcataataatatagtatcatcaaagaatatgaaagaagatgaattgttaaaagaacatcatttatatttaaagaaaggaagtgaagttgttcctaataatcaatattataatttaggggaatataataaattaaatttacaaatgttaaatattactgatttagatatattagaaaaacgaacagatataaatgatatatttaataatagtttgtcagaaacaaataaaagtgcaaataacaccaccaccaataataataataataataataatattcataataatattcataataatattcataataatattcataataatggagccgtacgaaccaatcccgtatcttccgaaaatcatcttattcttgataatagaaataataagaaaaaaacagacatgttggaaaatatgttatattgttcaactgttgaaagtaagttaatgggtttgaataaaaataaaatggaagcgaaccttgatatgaataatgataatataaacaatgataatataaacaatgatcatttaaataatgataatattaacaatgtggcaaggggacataccgtggattctgaacttaccacagaagacccagttatacaaaagaaaggagtatgtaaagataaatcaggaacgccatctgataacaaagttagtatatatgaattgttaataaatgcatttaacggtaagaaaaaaaatgtcaccaaaaatgtaaatgaaaaaaataaaaatggagtgaacgaagaaggtgtaggactaatgaatgatgcaaattgtaatacgaacaatatgaataatgtggacaataccaataatgtggataatacggataaattggacaatacggataacttggacaataccaataacgtggacaataccaataacgtggacaataccaataacgtggacaataccaataacatgaacaataacaataacatgaacagggatgataaagaccaatctatacttatgtcacagatcaaattaaagaacgatcatcgaattgaagaagaggaacttcagttgaaaggtaaaacaaatcataaggataatgtaataaatgaaaaaaggaaaagcatggtggaaaagaaaagcattagtctccataaaaatgttaataataatgataatcttgcctttttgaacaaccaacaagatgataatgtaagccacgcaaaccatacaagaagtaccatacacaaaatgagcgtgtttcataacaacaacatgagtaatattccatcaggctgtgcaatgcagaatgatgaagacaatatggttcttcttggtaacgagaatatgctttttaaaaaaggtggtagcataatgaattttggagatgttgataataatacaacttgtgcaatgaataaaaat

SEQ ID NO: 338 - DNA, 2256 bp, Plasmodium falciparum
ataatgaattttggagatgttgataataatacaacttgtgcaatgaataaaaatgagagaaggttaacaaataatatgaagagtggtcataacattattgctgataataaggatgaggagcttttgaatgtggaaaaaataaataatggagaattattacatattggtaagaacatatgttctgaacaattaataaatcaacgtaaagttgttgaatggaaacattcatttgaaaatcacaaagtagatatagtgaacacttctatgttattagaggagttgatattgaatcctacagtatgtaaatatgtaccaggtgaattatataatagaatattaaaatgttatgaaaagttagattttatgataacaaatttgaataatataaatgaggaaatggaaactatgaaaaatgtatataacacagaaggtaataataacaaaaataataataataataataataatgaacatggtgaacataacattgacaatattgttaataaaaatgttaggacaagtttattaaaaaatgataatataaaaacaacaacaaccgaaagaaataatagtataaaccattcgatgaataaaaatgatgtcagtatgatgtatgatgattttaaaaattattgggactcacctcttggaaaaaataatagcataaataatttgatgatgatgaataatagtataaataatattaacagtggttttaattcgatgaatctaacagcaagcgaattaatgaaaagcttatctaacggtatacatttgaatcaaaaaatgaatactttgacatcttccttgcctcatgactttttgttgaataataacatgttgggttctatgacaaataataataataacagcaataataataataataataataatagcaataataataataacagcaataataataataatagcaataataataatataaatttgggtatgactactcctttgaacaatgcaaatataatacagaaccatttaaataattccatgttaaaaaataatatggttaataaaaattccgcacataatttggctagtcacttgaataacaacaacaaagtatctaagaagaagtcgaccctttctacgtacaacaataatatgaatgaaggtaataatagtatgaatttaaatatgaatatgaattcgacaaataatttgaatagttccagtgtgatgatgatgttgatgaatagtgctcagaataattcgatacagaagaaatatattaataataataataataataattataataataatagtaatagtaataataatagtagtaatagtaataataataatgatatgacggtgttattgaataacatgaatgatgtaaggatcaatccaaacgttttattaaataataataatttattttttcaaggtaataattataagaaggatgaatcaaatactgggaataaaatgagcaaggatatgaatgttattaataatgcgcacgcgaatgttgaaataatgaaaaatgataacatgagcaataataacagcagtaataataattttgttgtaggtagagatttgaaggatataaaaactcttaataaaatattattgttaaataatagtaatttgaatagtgtaaagggagtaagtttgaatgaaaaacaattattaaattatattaataataataataataatagtagtagtagtagtaataataatatgagcggaataccatccgtgaactctaatattgatacaaatcttctaacccttttaaacatgacaaaaaataataacaataataataataataataataataataataattatattaataatattggttcgggaattaattccactggcattagtaataaaaaccttatgataaatcatcagaatgcaaaaaataataaccataacaataataataatgataaattcaaaggaaacccttttaatgattttaatggaatagttacttctaataatattaaaaaaatcttaaacaatgaaaataataataataataatttgtatatgatgaataataataaaacacccataaatgatattaatgtcaaatatgtagaagcattaaacagtcaatttaatttcttatcaagagatagtagaaagatagacacggaaaataacgcgattaacatattaaacttttcgaacgatctagaaaaaaaatctaataataccatggtagatatatgtgaaaagaccaacgacaaaaagatataa

SEQ ID NO: 339 - DNA, 1629 bp, Plasmodium falciparum
atgaaattttatagtccttttgttatttgttttattattttaaaagtatgtttaagtaaaaacataaatttaaacgatgaagggaaaaagaaacaaagcggcctaataaatgaaaatgaggatggaaaaaataataaaagtaataataataaaaaagttcaacataataaaattaatcgtaaaggaaataatagtgtaactaaaaaaacggatgaacataaaaatgatggtgatgcggaaaataaaaaaaatggtgaacataaaaatgatggtgatgggaaaaataaaaaaaatggtgaacataaaaatgatggtgatgggaaaaataaaaaaatggatgaacatttgtatgatattgatggggaaaataaaaaaaatggtgaacatttgtatgatgttgatggggaaaataaaaaaaatggtgaacatttgtatgatattgatggggaaaataaaaaaaatggtgaacatttgtatgatattgatggggaaaataaaaaaacggatgaacatttgtatgatgttgatgggggaaaaaataatattcttgaatataataacattgatcaacataatgaatttccagaaagcttagaaaacgataattcttatgataaacttttcgatgatgttgaattaagggatattattcataacgagaaattttttgagaatttaaaaaatgtgaataataacgatgtacataattttttattagtcgataaagaaatggaaagaagaaaggaagaggagaaaaaaaagagtagaaaattagaagaggacgaggaagacgatgaagatgaagaggaagacaatgatgagaaatggaaagaagaaaataaaaataatagtagtagtagtagtagtagtagtagtaataattttaataaaaattatgatatttatgataatagagatctttataattatgacaatcttgtggatattacacaagaagaacatataaatgtccctaatataaacgatgaaattaatgaagggcgtaaacatgataaggaagattttttaatatttgagaaaagattaaatgaagctgaagatagaaatgattcgagtgatggggataataaaatggaagatttaataaataaccattttgacgattcaggtgataatggatcttatgaaaatattcaagtaaaaaaagaattatataataaaaatgaaaagattataaaagggagagataataatctgaatgatggagatattcatatgaataaaaataatacaagtaataaattgaataataataataataataataataatgacaataatatgaatagtgagatgaaatataaaacatttaaagaagagtacgaagaacaaatattaagtaaaccagaatcgataaaatatttttttgaagtaataacagaaatattaatagtaataagattaggtttaatatatagatatacgaattttttaataccttttaagaattttcttatttcaaaaactttagaaaatgtcgaaatggtatgtgttacatttttatctatacataaatttggtagagaaaaatatcctgatatatatggtttttttttgataatcctaattttgtatatattaaaatatgtgtttaaaaaaatgatgtat

SEQ ID NO: 340 - DNA, 1626 bp, Plasmodium falciparum
ttgataatcctaattttgtatatattaaaatatgtgtttaaaaaaatgatgtataaattatattataataaatatggtatgggtaagaaatattctttgaaaaatcaagaaagtgaaaatatgtacatgcagaatttattaaaaaggattttgtataatgtagaaaaaaagaaggtcttatctaactatgaaagtatattacaagatatattagaaaacacagataacttattagtaaatagtaatataataaataaagaaaataaaaatatttatacagatatgatatcgaatattaataatataggagtctttacatatatatctacacaagcattaaaaaaaattaatcataaatcggatttaataattaatgaattaacaaccaatggttttattgatgaagatacaagtaacaaaatggataaactcaaaaacttcgcttccataaatgaatatccttatgtagatattaaaaagtttaaagataatctcgtcaacgaatatgatgagcactttatattaaacgataaaatgagatacagtggatttcatagtatggaaaatgacaagagtcctccgaatgataagtataacatggatagttataatatggatagttataatatggaaaacatgaacatggaaaacatgaacatggataatatgaacatggaaaacatgaacatggataatagcaacatggataatagcaacatggataatatgaacatggataatagcaacatggataatagccacgtggatatgaataacatgaataataataacatgaataataataacatgggtgtacatataaatatgaataacaattatttatctaataaatataaacacaattctgcatatgatgaaaataacgtgcaggactttttacagaaatcaaaaaagcaagattatggacatgtaacgaatacactgaaagatgggaagcaaatgatttataataacatggatccgaataataaaaaagatgataattattttaagaaaatgatgagagattcagacttatcaaattataacggaaggaaaagtatgtatttaaatgaatcattagaagatgacatgaaaaataatgattatgataataagattaataataaaaattttgattatgcaaataataatagcacatatattgtagaaggtaaagaaattcaacaaggtgaaaaaaataaaacaaatgatatggatgaaaaaaaaaaagatgaatcctttattcattatgacaataaaaaaataataaataatttaaaccccttctcccctttgaatgattataataatatttctaataataaaaagaataccataaacgaagaacaaaataataatgtaaatgaatctgatgttataacatacatagcaaattcttatataaataaaccacctagtaatataaatagatttagtcaaacttctatttataatacacataataaggtaaccaaccccttattaaatacacaaagaaatgtaccaaaagaagtaacacaacgtaaaaacacggaagcatctgtaaataataatgtcgaagaaaattatctgagaaacaaggttacgaaccatgatacggaacaaagcgtggagaacaaattg

SEQ ID NO: 341 - DNA, 2289 bp, Plasmodium falciparum
aaatttaatttaaaagatgacacacatcatagtgacgacaaaaaacattcaacagatcacgagaattcaaaaaaacataatatggatcatattaataactctcctatacaagaagaaaaaaataataaaataaaaattgttttaaaagattcaaatgtggtaaacaattttgaagaaaatatgcaacacaggaataaatcggaagaaaaaaaatctaccaaaatgttaaagaaaagaaaacgaaataaaaatgtaattctttttgaagaaaatatttttgataattatttggaaaataaaaagagctgtatgttgaaatgtgagaaaaatgtctttataaccgactgtttttattataaaaatatttttagaaacctgcacgagtttattgatgataaatcgactgaggggaatgatgaaaaaaggagttctcatcaaaatggtacaagttgtgaaaatgttataagtaatgaaaatgtgcataatgatgataatgtaaacaatgatgataatgtaaacaatgatgataatgtaaacaatgatgataatgtaaacaatgatgataataaaaataatgacgataatgtaaacaatgatgatactaaaaataataatataaactctggtgatgtggaacaaaatgatattcgtaacctaaccgaagaaaccaaacctatttacgataataaagaaaatattaaaaaattatggaaagaaaaaatgaccacactttataattatgataatacaaattgtaaaatacacgtatttcattattcaccaaatgaagataaaaataatacatatattacaaatgatgtcaataatgtcaatgaaaattttaaaattcaatctacccaaaaaacaaataatgtgcatgaacaagatggaaatattctgactgttcaggaaaaaacgaaagattttatgaacaagtcatgcaatatttcaaatgatgataaaatatgtatacatataaaaaaaaataataatattccaatgagtaatataccaaaaaatgtgtttaggggtttttcggaagtttatcaagacgaaagttcttcagaagatgaaaataatataaatgaaaagaatataaatgaaaagaatataaatgaaaagaatataaatgaaaagaatataaatgaaaagaatatgaatgtacataaacatgcaacaaatgatcaaataaacgaaagttatgaatgtgcttctttcaacgataccttaaaatgcgacgtggagtatgaaaagaacgtccccgcatactttttaacttatggaaatattattaataatataatttctaacgaagaggagacacatcaagctaatatttctcaaatgaaaaatgaaaataagaattgtaatgtttatgataaggatatgtctcatactcaaatggaaaggaatgtagcgaaaaaaagtgattataataatgagaagaaaaaaaacgaagttatattgaagcatactagtgagggtaatggtaatacttataaggacgataaaaattatgatgataataaaaattatggtgataataaaaattatggtgataataaaaattatggtgataataaatattatgatgataataaaaattatggtgataataaatattatgatgataataaaaattatggtgataataaaaattatggtgataataaaaattatggtgataataaaaattatggtgataataaaaatgatgatgataataaaaattatgatgagaaccttatgaatagtgacgattccattcttttcaacataagtaacaaaaatttttataattttcatttattatttaaaaaggatgagaaattaaaaaaggagttttttttacaaaataggataagcgaaaagaccttattattaaatttgtatgttgattatagtagtatggaagatacatcttttttccgtataaataatacgaatttttataattattattttgatgattatttttatttttttataaaatcatgttatgatttagatttatatataaaaattcagagaaaaaatatcttcttaactgatgaaaagtatttcgaattcttaaaaatacacataatgaataaatctacaaaaaataaaaacgtcccattttatttgtgtaataattctgtagaacaaaataataatttaatacaagttttacaaaagtgttttaaacattttaatttatataatggaaatagttcaagtaccttaactttatatgattctgtaaatgaaatatcttttcttctttcacaaataaggatatatataaag

SEQ ID NO: 342 - DNA, 2139 bp, Plasmodium falciparum
gaagaggtatcagaagataaaggggatattgaagaggtagaaaaagaggagacatcagaagataaaggggatactgaagaagtgagggaagatgaggtatcagaagatatagaagattctgacgaagtaggagaaggcgaagtatcagaagatatagaggattctgaagaagtaggaaaagaggaagaaccttatgagaaaggcgattatgaagaagtaggaaaggaggaagcatcatatgataaaggagatgctgacgaagtatcagaagatatagaggattatgaagaattaggaaaagaggaagaaccttatgagaaaggcgattatgaagaagtaggaaaggaggaagcatcatatgataaaggagatgctgaagaaataggaaaagaggaagcatcagatgataaaggagattctgaagaattagggaaagaggaagaaccttatgagaaaggcgattatgaagaagtaggaaaggaggaagcatcatatgataaaggcgatgctgaagaaataggaaaagaggaagcatcagatgataaaggagattctgaagaagtaggaaaagaggaagcatcagatgataaaggatattctgaagaagtaggaaaagaggaaggatcatatgataaaggagatgctgaagaagtcgaagatgaagacgaagagcatataaggagtaaagaagaagtaaaggaaccagaaataggaactgatatcgaagaagaaaataaagaaaaatatataaaaaaattagatgtgcaagatacgttatatgaaattaatgttttaaatggagaagatataacttcctttttggaaaataaaaataaaattatacaaaatgaaggagaagaagatgatgatgatgatgaagatgatgaggatgatgaagatggtgaagatgggaaaggtgtatatattaatatagttaataatgttcctggtaatatctggaatgatacaatatatgatgataattataataataatacatatagtagtgcagaagaatatattttttatgaaaaaaaattagatgataatacaagaaacaatatgaaaagaagttattatgacattttagatgtaaaagaagattccgatataaatgaaattaaaagaaagttttataatttatctttaaaatattacccaaagatgaataaagataaaaatttagtgatgaatcaaaaatttgagaatataagtgaggcatatcaaatattgggttatgaaaatagacggaaattatatgatttaggagaatatgatgaaacaaataaaatgataattattgatccattaatattttttaatttaatatttacatctgatatgatgtatgaatatactggaaatactcaagtatctacttttgtaaaattattttttgagaaaaatatttctgttgaagatatatcttattatgttggtgagattatgaaagaaatgatggaagggcaaaatataagagaagagaaagtagctgaattattaaaagatagattagatttatatatagataatgaagatgaatggaagaagttaatggaaaatgaaattagcatgttattaaagtcttcattttctagttttatattagagtctataggatggacatatgagaatgtttctaatatttttttagaagaaaaagtaaattctggtaaaaataaaaaaggtatatatttaaaagaagctaatgagagaattattagaaattcaattgttttgagacaatgtaaaagtcgttttatatctataataacaaattattatccttttaaagaacaaaataatccttttataaagcaggcacaatatgtatcctcatctaattatgtattggatgatataataaataatatagactatagtatagataatatacatagagccatagataatttatactatgaacatatattaaatttattagaggaagaaaaaaatgaaatactagaagaaatattaaggaatattctaaaaattattttgtgtgatgttgaaacaacggtaagaagatcagcacaaaaagtattacaaaatgcagaaggagatacaaatttgatgcttaaaagagctaaaggattacaatcattgggtaaaatgatattacagaaggttaattga

SEQ ID NO: 343 - DNA, 1818 bp, Plasmodium falciparum
atgttaaagaaatatattatattaatatatatcggtgtaattctaaatttcataactaaaaataataatgtagtgtctgttcctgagccctttttatcacaaaacaaagattcttttgaagaaaaaaaatatacgtatggggataatttacaattgggggcatcaactataaatacccctaaaacacaatcacaagaaaataaagatataaataaagaaacaaaaaatacaataataaaaaaaacgaataattttccaagtaccttaaatgagaaatttcctcataaaattcaattaaccaataaagaaaataaagaagatgaacaaaataaagaaaataaaaaagatgaacaaaataaagaagatgaacaaaataaacaaaataaagaagatgaacaaaataaacaaaacaaggataaaaaaaatatagtaagtaacaaattatcgggaaacaatgaacaacagaataattctattccaaaatcaatacaaaaaccagagaattgtgtcaaaaaacaaagcaatcaatttcctcgtagttatccagaattctttgaagcaaattttggacccatagatgaacttatggatgaaacggattatagtagtgatgatttagaagatcaactaaattatggttatagaggaatagaacatgatattgatgaaacagattattatataggaagtatattaggatatagtgattttatgaataaaatgaaatatcagaatacacaaattgataataacaaaggaaaaaaaactacaaacactatggaaaaaaacaaaaagaacagagataagaaacattctaaaaaaaggaaaacaaaacaaaattataaatataagaaggaaaaccaaaatatagaaaatcatatacctcaaagtaaatataaacaagaacgaattgaaatattagatgataatggaaaagaattgaaatcccacaaaaatattaaagaagaaaaggggggaatagaaaaaactgatactactaatatagcagatataaaaataaaaaaagaagaaagagaaacaaaagatgaaaaagaaaaaaacattcaacagctagtaaaagatgtacaattaataaaagttggagaagaaacgaaagacgacgaaaaagaagacaaagaaggaacagatgatgaagaagatacagatgatgaagaagatacagatgatgaagaagatacagatgatgaagaagatacaagtgatgaagaaactacaggtgatcaagaaaacaaagaagaaacagaagtagacgaaaaaaaaacagaaaaagccgaagaagaattagaagaagacaaagaagaatcagaaaaagacaaagaagaatcagaaaaagataaagaagaatcagaaaaagataaagaagaatcagaaaaagacaaagaaaaaactgaagaagatgaagaaaaaactgaagacgaaaaaggaacggaagtatacaaaaaagaaacagatgtagatgaaaaaaaagaaaagggagaatatggagagggaacagatgatgaagaagacaaagaaaaagaagaagacgacgaagaaacaaaagtagaagaaaagaaaacagaaaaagacgaagagggaacagattatgaagaagatacagatgattcagacaaagatgaagaaacaaaagtagaagaaaagaaaacagaaagagacgaagaagaaactgaagaagacgaaaaagaaacagaagtagaaaaaaagaaaacagaaaaagacgaagagggaacagattatgaagaagatacagatgattcagacaaagatgtagaaacagaagtagaagaaacagacgca

SEQ ID NO: 344 - DNA, 1815 bp, Plasmodium falciparum
gatacagatgattcagacaaagatgtagaaacagaagtagaagaaacagacgcagaagacaaagaagaaaacgaagagggaacagatgatgaagaagacaaagtagaagaaacagacctagacgaccaagaagaagacggagaagaagataaagaagacgacaaagaaaaagacaaagaagatgacaaagaagatgacaaagaaaaagacaaagaagatgacaaagaaaaatacaaagaagatgacaaagaagatgacaaagaagatgacaaagaaaaagacaaagaagataacaaagaaaaagacaaagaagataacaaagaaaaagacaaagaagatgacaaagaaaaagacaaagaagatgacaaagaaaaagacaaagaagataacaaagaaaaagacaaagaagataacaaagaaaaagacaaagaagatgacaaagaaaaacatgataaacatgtaagaagaataaaaaagaaaatgaaagatgatgactatgatgaaagtttgaaaacgaaaaattattatccacataatatgacatttggacaacaacaatatttcccatactataatccattagaacaacagaattatcaactacatcatattataaaacaacagcaaaattatcacccacatcatattataaaacaacagcaaaatcataatccacatcatattttacaagagcaagaaaaacatcacccacaaggtataccaaaggaacaaccatataataatgttccttatatcttaaaaaaggggcttgaacccaaaactcataaccatgtaaaagaagatcaacctaatattaaacagggtgttgtaaagggacaagaaccacatgttgatgatatgcataacaatacaaaagaacataagaattttaaaaatacaaccgatgtaaaacaaccagcaagtcatatatataataattcatcagaaaaacaaattgaacatgtatataataagtctcctgaaaaacaaattgaacatgtatataataagtctcctgaaaaacaaattgaacatgtatataataattctcctgaaaaacaaattgaacatgtatataataattctcctgaaaaacaaattgaacatgtatataataattctcctgaaaaacaaattgaacatgtatataataattctcctgaaaaacctgcaagacatacaaataatatttcattagaaaaacaaaatagtcataaatataatgttaatatacaagatcgacatgatcctgtatattataaatatgaagatatgttaaaaagagataaagatttgtttacaattatcaacaacatttgtgaactggaatttaattctacaaataactatttaatgaaaataattaataacgacaaattaaaacataattctttaaatgataatgaagccatattaaaagaaataactaaaactcaaaatgaattgttttctttaaaattaccattagaaattaaagtatcaatggctcttcgtataagtgaacgtttacgtgcctttgtttttgataaagatttaacagcttattatataaaaaaattaaaagatatatttaaattagaaacagaggcagcaaaaaattattattattatgtaaaatgtcaaaaaacgtttagtgataaaaaacgtttggttaataatttagattcaataaaattatactatgaatcacaaattaataaaaattttattagcatacccaaagataaaatacctacagctatatatcgtatatccaacttagttaatgatttaatttttttacttccacaatcaaatgcaaacaaagcattataa

SEQ ID NO: 345 - DNA, 2520 bp, Plasmodium falciparum
ctttataataatttatcttcgaacagggattctactgtagatatgcataataaatataatagtgaagaatatataaatatacagagaacaaataaaatatatgaattgagtaataaaagaattagaaattataaattgtatagtatggatgaaatatttaaggtgtctcttaaggaaaaaaaatatatagataatatttctaataatatggaaagagtaacatataaaaatgaaatgataaatgaaaagataagtaagatggacgatatattatatccttgtgacaaaaataaatctttaaacatgtcttgtcctgttataatagaaaataatatatcaagagaagaaaatgaaaaaaattcaagtgttatattaaataaaaaaaagaatgagaatatgtttaattgtgttggaaggttacattgtcacatgggcaaaatgaataatcaagataatatatatgaccaagggaatataaaaaaaaatgaagaagaaataaccaaacatgatgaatatatatcaagggaagaaaaaaataaatataatagtaaatgtattagaaattttgatgactataaatatgaacaagtgttgagttaccatacgttggatgaagacaaaaaaaaaaatgatatgaacaatttaatagatatgaataatgaggcgattattgaaacggtgaatggtgttattaataatattatattggatagaaaagataataacagtaggaaggatatggagaaagagatggagaaggagatggagaagaagatggagaaggagatggagaaggtgatggagaaggagatggagaaggtgatggagaaggaggtggagaaagaattgaaaaatgagatgaacaataggatgaacaataggatgaacaatgagatgaaaaatgaaataaacatttataaaaacaatgagatatatgtagataatgataaagaactagaaattgtaaatgaggagaagaaacttatttacccatttaattacgaatctgatgtacataaaaatatgaatatgtcaattaatataaataattgtaaagatgattataataatatattaaaagaatatgtagataattcatgtcttgctcaaaaggaagagaatatatttcgacctttattcaatttaaataagaaagataaagtatggaaacgttttaatataaagaataatattaagacaataatacataatgaagagatgaaaagaatatatcaaactattaataaaaatgtttttcctatttataattttaatcgatatgaaaattttttaataaatcatttaacatataattttccaaaaaatgatttatttaaattatcatacaaagtaagtatgaataatataaggaatttgtatattgctaataaacatataaataataattatgattatatgaataaattatataatcaaaatatatatacattaaaatatcaggtagctaatatagataatgatcatcatatatgtaagaaagggggagggttggattatataaatatgaatatatcaaaagaatgtaaaaataggaaagacaaaacatatttaaataaaatatttcattataagaagaaaaaggatgcacgcttttttataaatgacgaaattggttctaatgattatatgtatgatataaaaaaaaaatatagtaacgatgaaaataattataaattaaatgaaaagatgaacatatctatgtcaaatgatgaagatatgattcctacgttaaatagtgaacatggaaataattttccaagttgtcaaccgaatttattagaaaaaaaaagtacttatatagatttgaacttatatgatagtaattctatggacgattttacagaagaaaaatataattttgttaataatgaaaatgatttattcaatactaaaagatggaagtttaatttttccaagggtaaaaatctgtttaataataaattttttaatgtatctaatgaggatggtgtgttttctttttttaaaaatatgaatctttttagggaacttaataaatcaaataatagcttaaaactagagagtgttaaaaatagtaataataattgtagtaataataagggtgatgataatattggaaatatggagaatatgaatacaacaaatgttacaattgcgagtgatgaacatatatctacaaagggagatatacacgacgaatcattttctagagacgataatgattgtatccttttaaaaattgaaggtagaagtaaaaaatatagtgatataaccttatataatgaggacaaaagtaatttggagaatgacaatgagactattaatgaatatgaaaatgtatgtagtaacatagatgttaatgaatgggaagataaggtaaatggtacatgtaatagtgttggtgataaagagactgaaaagaataatgaaaagaataatgaaaagaataatgaaaagaataatgaaaagaataatgaaaagaataatgaaaagaataatgaaaagaataatgaaaagaat

SEQ ID NO: 346 - DNA, 2517 bp, Plasmodium falciparum
aagaataatgaaaagaataatgaaaagaataatgaaaagaataatgaaaagaataatgaagaaaataatgaaggaaataatgaagaaaataatgaagaaaataatgaagaaaataatgaagaaaataatgatatagaaaagaatgatataaaggataataattcgggacaagtgaaagaaaatataattgttatgaataatacaaacaatatggatgttgataatgatgataataacaataattacaataatgttagtactgatgaaggtatagatataattaaaaacatcaaaagtgagatgaatgattatatttataatgataatattatgattaagataaataataaaagtatagatcttatgaatataaaaaatcaaaagaatgaaccttttttaaattatacaaatgaaaaggatatacatatgaagagcaattcatcatataatgtaaatgataaaatgaatttatttaataataatgagaaaacagaaaaaaataatactagtttaaacgatttattatataaaagaaaagaagaattagatgatgaaaaaatatctgaatataaggatacaaatttaacaaacaatacctttgaacatatagctaaaaggattaatttaattttgaatgatacaattgaattttttcaaaaacatacatatcttcataatggttatggtaatgttcaggtgtgcaaaaagaacaagaggaaattagaaaaaaagaagttgaaaaaatggtcctgtatttataaaattaataaaattgtacgtaaaggggcccacggggtggtgttttctgcgtggagaagtgagaatgttgatttttttaatcattcgttttttgaaaacttaaatttggagaataaaaagaagggatatatcgatgaaacaaatgttaatgaaaattatgagtctgataatgaatatgatagtgatgaagatgatactgaaagtgataatgatgatgagcaaaataaagagaatgaaagaggtgatgaaaaggatggatatgaagaaatgaatgggggagataagaatgaagaaatgaatgggggagataagaatgaagaaatgaatgtgggagataaaaatggaggaataaatgaggaacataaaaatgaaggaataaatgaggaacataaggatgaactaataaataaggaacataaaaacgagcgaataaatgaggaacataaaaacgaacgaataaatgaggaacataaaaatgaaggaataaatgaggaacataaaaatgaaggaataaatgaggaacataaaaacgaacgaataaatgaggaacataaaaatgaaggaataaataaactgacctatcataatatgaataaaaataatatttcaaatgaaaataattataatgatgacgattcttatgatgaagataatttggtatccctgaagataataaacttaaaatatttaagtaaaaagaatagtttaaaaaacattttgagagaagtaaattttttaaaaatgtgtgaacatccaaatgtagtaaaatatttcgaatcttttttttggcctccttgttatttagttattgtgtgtgaatatttatcaggaggaacattatatgatttatataaaaattatggtagaatatcagaagatcttttagtatatatcttagatgatgtattaaatggtttaaattatttacataatgaatgtagttcaccacttatacatagagatataaaaccaacaaatatcgttctttccaaagatggtatagctaagataattgattttggttcttgtgaagaattgaaaaatagtgatcagtctaaagaattagtgggtactatatattatatatcacctgaaatattgatgagaactaattatgattgttcatctgatatatggtcattgggtattacaatatatgaaattgttttatgtaccttaccatggaaaagaaatcaatcatttgaaaattatataaaaaccataattaattcatcaccaaaaattaacataacagaaggatatagtaaacacttatgttattttgttgagaagtgtttacaaaagaaacctgagaacagaggaaatgtgaaagatttattaaatcataaatttttgattaaaaagaggtatattaaaaagaaacctagttctatatatgaaataagagatatattaaaaatatataatggtaaaggtaaaacaaatatcttccgaaatttttttaagaacctttttttcttcaatgataagaataaaaaaaaaaaaccaaataaaatgatcagttccaaatcctgtgatgcagaaatgttctttgaacagttaaaaagggaaaattttgatttttttgaaattaaattaaaagatgatgaaaatagtagatccttgaatacgtttaatataaatatatctaaagaaagagacgacatatcatattcttctttaaatttggaaaaaatcaaagaacacagtctcaatatggtagcatctgttgtcgggactgaacaatcccagaaatga

SEQ ID NO: 347 - DNA, 2301 bp, Plasmodium falciparum
aatgatattataagagatacgcatgataagtctgatatatttaaaaatattaaaatagataataataaaaaatatgaaatttataatttagagcttgaacaagaagaaattaatgaaaaaaaaaattataataaaaataataatgatagtaacaaaacgttctttttaaaaatagagaatgaatttaaaaaagaccttttattagatgatagccaaatttttggtgatagccttttagctgatataaaagaatataattatactgctgataatttggataataataatgaaaacaaaagtttatatgaagatggcgaaaattttataactaggaatgagcctattacaaatgaatatgaagaaaaaaataacataatatacatatcagatgaacaaaaatataatgaagaagatattatatttaaagacaaaataaaggaaaaagagaaaaacaatgatacatcaagtgatgattttgaaaattgtagtgtacaggaaaaaatatatgtaaatgaaaaaatagaagaatataataataaaaatgatgataaatcatcttcatcatcatcgattatattagaagaaatcaaatataaaaaggaaaaaaaagatgagctcgttagccctaatttgtgtgttctacttgatgaatttgagcattctaatgatctggagaataattatatttccgtttcttctgatgatatgaaaaccaacgtgagcaaaaacaatattacaggagtaaaggaaaataaagtggacaaaacaaatgtggagtatgataaaaaaggagatgatggggtaatagaaatatcttttgaggatagtcataaattagaagagtcaaaatttgatgataataacaatatttatgataatgatgacgaattagaaaaaaatttatcaaaggattatatttcggatgttgataaaaaccatgtaaataatatatataatatcgaacgaggggaagatgaaagagaaaacgaatttgtagagaataaaatacagtcgacagaatcacataagagtaatgaatttatatgtacagaaaataaaagtttgagaaaacaatatatgagtaaagaagatataagtaatgtgcgaatacttaaaagtgatgatattaacaatttgagtaaacaaaattattttgaaatattattagataagaaacaagttatggataattttcagatgaatattgaacaaaataatgataaattaaaagaagataaattagatgaaggtgcttattttgaatatttagaagataataaaataattgattcatatataaaagaaacaaataaagaaaatgaagaattaataaaagaatataaaaagttgaaaaaaaataatattgaaataaatgatgaaatgaatgatgatataaaattattattaaatttttttggtatcccatatatacaatctccatgtgaagcagaagctcaatgttcatatttaaataataaaaattattgtgatgctattattagtgatgattcggatgttttagtttttagtgggaaaacagttataaagaatttttttaataaaaaaaaaacagtcgaagtttatgaaaaaaaagctattgaggaaaagttaggattgtatcaagaagaattaattaatatttccttattatgtggatgtgattatacaataggtgtgcatggtataggtattgttaatgctttagaaataattaaagcctttccaaattttgaggatttaaaaatattaaaagatattgtatcgaacccttttagaaaaatagataaaaatatgtataatgaagaaatacagcaattcttaaatactcataaaaattataaacttaattggatattcccaaataattttcctgatagagaagtctataaatgttttaagtatccaaaggtatgtacagatattaaaaaattcgaatggcatgtccctgatattaagagtataacaaaatttttacataaaactacaaatatatcagaagaaaaagttcttaatgtcctaaacccaattttacaaaaatataatgttaatgttagaacatatcaatcaaaaattgaggacttctttccactcttggagaaaaaaagaaaaactgtagatgatttaattgatcatattagagcaaataataaacaaaagagacaaaaaaataaaaccgttcatttggatagtaaaatatcaccattgattgatataaatccagcaggaattatcaaatctaagagaatgtcatcggccttggatcatataaaaaggagaaaatcaagcaagaaaaaaaaataa

SEQ ID NO: 348 - DNA, 819 bp, Plasmodium falciparum
atgaaggtaattaaaacattgtctattataaatttctttatttttgttacctttaatattaaaaatgaaagtaaatatagcaacacattcataaacaatgcttataatatgagtataaggagaagtatggcagaaagtaagccttctactggtgctggtggtagtgctggtggtagtgctggtggtagtgctggtggtagtgctggtggtagtgctggtggtagtgctggttctggtgatggtaatggtgcagatgctgagggaagttcaagtactcccgctactaccacaactaccaaaactaccacaactaccacaactactaatgatgcagaagcatctaccagtacctcttcagaaaatccaaatcataaaaatgccgaaacaaatccaaaaggtaaaggagaagttcaagaaccaaatcaagcaaataaagaaactcaaaataactcaaatgttcaacaagactctcaaactaaatcaaatgttccacccactcaagatgcagacactaaaagtcctactgcacaacctgaacaagctgaaaattctgctccaacagccgaacaaactgaatcccccgaattacaatctgcaccagagaataaaggtacaggacaacatggacatatgcatggttctagaaataatcatccacaaaatacttctgatagtcaaaaagaatgtaccgatggtaacaaagaaaactgtggagcagcaacatccctcttaaataactctagtaatattgcttcaataaataaatttgttgttttaatttcagcaacacttgttttatcttttgccatattcatataa

SEQ ID NO: 349 - DNA, 516 bp, Plasmodium falciparum
atgaatatattatgtattctatcatatatttattttttcgttattttttatagtttgaatttaaataataaaaatgaaaattttttggttgtcagaagattaatgaatgacgaaaaaggagaaggtggttttacaagtaaaaataaagagaatggaaataataatagaaataatgaaaatgaactaaaagaagaaggttctttacctactaagatgaatgaaaaaaattccaattcatcagataaacagccaaatgatatttcacatgatgaatcaaagagcaattctaataattcacaaaatatccaaaaagaacctgaagaaaaagagaacagtaaccctaatttagatagtagtgaaaattcgagtgaaagcgcaacacgttctgttgatatatcagaacataattctaataatccagagacgaaagaagagaatggagaagaacctttagatcttgaaattaatgagaatgcagaaataggtcaagaacctccaaatagattacattttgac

SEQ ID NO: 350 - DNA, 486 bp, Plasmodium falciparum
atgtggatagttaaatttttaatagtagttcatttttttataatttgtaccataaactttgataaattgtatatcagttattcttataatatagtaccagaaaatggaagaatgttaaatatgagaattctaggggaagaaaaaccaaatgtggacggagtaagtactagtaatactcctggaggaaatgaatcttcaagtgcttcccccaatttatctgacgcagcagaaaaaaaggatgaaaaagaagcttctgaacaaggagaagaaagtcataaaaaagaaaattcccaagaaagcgcgaatggtaaggatgatgttaaagaagaaaaaaaaactaatgaaaaaaaagatgatggaaaaacagacaaggttcaagaaaaggttctagaaaagtctccaaaagaatcccaaatggttgatgataaaaaaaaaactgaagctatccctaaaaaggtagttcaaccaagttcatcaaattcaggt

SEQ ID NO: 351 - DNA, 2157 bp, Plasmodium falciparum
gatacttgtgatgcaattgccactgactgttttttgaatggtaacgttaatattgagaaatgctttcaatgtaccttgctagttcaaaaaaaagataaatcacatgaatgttttaagtacgtatcaagtgaaatgaagaaaaagatgaacgaaataaaagtcaaggcacaagatgatttcaatccgaatgaatataaattaatagaatctattgataatatattgagtaaaatatataaaaaagcaaataaaccttttgaaattagtaaagatttaattaatttagaagatttagattatcaatttaaaaatgaattattagaatattgtaaattattaaaaaaggttgatactagtggaacattagaagaatacgaattaggtaatgcagaagatatatataataatttgactagattgttaaaatctcattctgacgaaaatattgtaactttacaaggaaaacttagaaatacagctatctgtataaagaatgttgatgaatggatattaaataaaagaggtctaacattacctagtgaatcacctagtgaatcatccagtaaatcagatagttatcttaacacttttaatgacaaggataaaaacgaagataaggatgatatgagtaaaaattcgaaggaggagtttaaaaatgatgacaaagaaaattctgatgaccaaaacaataatgattctaataaaaaagatgatgagaataatataaataatggtgatactaattatgtttatgattttgatgatgatgattatgataacaatagttatgagaaagatatgtatgaaagccccataaaggaaaataagaatggtgttattgatttagaaaaatatggtaaccaaataaaattgaaatcaccttattttaaaaatagtaaatattgtaattatgaatattgtaatagatggagagataaaactagttgtatatctcaaatagaagtagaagaacaaggtaattgtggattatgttggatatttgcatctaagttacatttcgaaactattagatgtatgaggggttatggtcatttcagaagttcagcattatatgtagctaattgttctaagagaaaacctatagatagatgtgaagaaggatcgaatccattagaatttttacgaatattagatgaaaagaaatttttacctttagaatctaattatccgtattcatatacaagtgcaggtaattcttgtcctaaattaccaaatagttggacaaatttatggggtgatacaaaattattatttaataaaaaagttcatcgttatataggaaataaaggatttatatcacatgaaacatcttattttaaaaataatatggatttatttatagatatggtaaaaagagaagttcaaaataaaggttcagttattatatatataaagactcaagatgttataggttatgattttaatggtaaaggtgtccatagtatgtgtggtgatagaacacctgaccatgcagctaatattataggttatggtaattatattaataaaaaaggagaaaaacgatcttattggttaattagaaatagttggagttattattggggagatgaaggaaattttagagtagatatgttaggtcctaagaattgtttgtacaattttatacatactgttgtattttttaaactagatttaggtacaatacatgtacctaaaaagaaatcttggaaaaaaaatgtttatttcttaagacataatcctgattttatgtatagtttatattataataattatgaaccagaaacatctcaagattttgaaagtgagaatgattatgacaatgcttttgtacatggacaaagcaatgaatcagatgaaactaataaagaaggaaaaaatgtccacaattctgtggagaaaaaaatacaaatactccatatattaaaacacattaaagattcacaaataaagagagggttagtaaaatatgataatataaatgaaacaaaagatgaacatacatgttcaagagttaattcacaggatgcagaaaaatatgaagaatgtaaaaaattctgtttaaccaagtggaatgaatgtaaagatcattattcaccaggttattgcttgacagatttatacaagggagaagattgtaatttctgttatgtataa

SEQ ID NO: 352 - DNA, 834 bp, Plasmodium falciparum
tgtgttatatttaacaaaaatgttataaaatgtacaggagaaagtcaaacaggtaatacaggaggaggtcaagcaggtaatacaggaggagatcaagcaggtagtacaggaggaagtccacaaggtagtacgggagcaagtccacaaggtagtacgggagcaagtccacaaggtagtacgggagcaagtcaacccggaagttccgaaccaagcaatcctgtaagttccggacattctgtaagtactgtatcagtatcacaaacttcaacttcttcagaaaaacaggatacaattcaagtaaaatcagctttattaaaagattatatgggtttaaaagttactggtccatgtaacgaaaatttcataatgttcttagttcctcatatatatattgatgttgatacagaagatactaatatcgaattaagaacaacattgaaaaaaacaaataatgcaatatcatttgaatcaaacagtggttcattagaaaaaaaaaaatatgtaaaactaccatcaaatggtacaactggtgaacaaggttcaagtacgggaacagttagaggagatacagaaccaatttcagattcaagctcaagttcaagttcaagctctagttcaagttcaagttcaagttcaagttctagttcaagttctagttcaagttcagaaagtcttcctgctaatggacctgattcccctactgttaaaccgccaagaaatttacaaaatatatgtgaaactggaaaaaacttcaagttggtagtatatattaaggagaatacattaatacttaaatggaaagtatacggagaaacaaaagatactactgaaaat

SEQ ID NO: 353 - DNA, 942 bp, Plasmodium falciparum
attagcggtatcatattcatagggagaggactttccgtgttcattatttgccctttacagaattattacataaataaatataattatatgccagattatatgcccgaaatagaaaactccgatgagaaatattttagtaacttagatatattaaataaggtaccttatttgtttatatatgaaggaatatgttttgctattattcagtttttgggttcatatttaattgcagattcaggtgatacatctaaggatttcatggcatataatgataggaataataaagtattatattttgaagaaaaaaattttataaataagccaaatggtttatctaattctttaagaacattatcgaatacatcgaatttttcatttagagaagtaaataatacatttattaatcgtgaatttatattaatatggttaatgatcttttttaattggcaagctatatcatatactcaagtattttggaaaatatttgggatgaattatttatctattgatgatagatcattatcattattaggatctgtatcttctctttttaatatttttggtaggatcttttggggacttataagtgactttacaagttttaaaacaacattaatattaatgagtcttcttatgagctttttaacaatcacattaacaatgtcaggattttatggtattataacttattctatatgggtatgtcttattttcttttgtcatgctggcacttttgcaatattcccatccataactgcccatacatttggaaccaaaaatttcggaccagtttttggactcctatttacagcacgagctttttcaagtataattaatgcaatcatatcagctgtcttgttaaataatattggtaatattgcaatgtgtgcaattgtttccttatcatcctttgtcagcatcatgttagcactagcattttaa

SEQ ID NO: 354 - DNA, 552 bp, Plasmodium falciparum
tggcagagttatccatttttaaagaagaatatgcccaaggttgatattttttcagaagaacatatttcaaagtgtgctttaagcgtttttgataaagagaaaggtaactggtttgtaatagacgctacaaataaaagtgtaggaagtttagctgcatgcattagtaaattattacaaggaaaatatagagttgattacaatcctaataaagttaatagtagtagtgttattgttgtaaatgctatacatgtgaagttttatggacatacatgggataccaaaatttataaattcccaagaaaaagtcattcaaaaagtcataaaattttatcatgtaaaacagtctttgctagaaacccatccatgattttaaatctagctgttaagagaatgctacccaataacagacttaggcaaatcttttatagaaaattatatgtatatccaggagccctacatccacattggggtataccacaagttgtagtacccaaaaaaaatgtagtcaaaaaggaagagcagcaagatataaagacctttaccattttgtaa

SEQ ID NO: 355 - DNA, 2268 bp, Plasmodium falciparum
tctgatataaacaagagttggaaaaaaaatacgtatgtagataagaaattgaataaactatttaacagaagtttaggagaatctcaagtaaatggtgaattagctagtgaagaagtaaaggaaaaaattcttgacttattagaagaaggaaatacattaactgaaagtgtagatgataataaaaatttagaagaagccgaagatataaaggaaaatatcttattaagtaatatagaagaaccaaaagaaaatattattgacaatttattaaataatattggacaaaattcagaaaaacaagaaagtgtatcagaaaatgtacaagtcagtgatgaactttttaatgaattattaaatagtgtagatgttaatggagaagtaaaagaaaatattttggaggaaagtcaagttaatgacgatatttttaatagtttagtaaaaagtgttcaacaagaacaacaacacaatgttgaagaaaaagttgaagaaagtgtagaagaaaatgacgaagaaagtgtagaagaaaatgtagaagaaaatgtagaagaaaatgacgacgaaagtgtagcctcaagtgttgaagaaagtatagcttcaagtgttgatgaaagtatagattcaagtattgaagaaaatgtagctccaactgttgaagaaatcgtagctccaactgttgaagaaattgtagctccaagtgttgtagaaagtgtggctccaagtgttgaagaaagtgtagaagaaaatgttgaagaaagtgtagctgaaaatgttgaagaaagtgtagctgaaaatgttgaagaaagtgtagctgaaaatgttgaagaaagtgtagctgaaaatgttgaagaaagtgtagctgaaaatgttgaagaaagtgtagctgaaaatgttgaagaaatcgtagctccaactgttgaagaaagtgtagctccaactgttgaagaaattgtagctccaagtgttgaagaaagtgtagctccaagtgttgaagaaattgtagttccaactgttgaagaaagtgtagctgaaaatgttgaagaaatcgtagctccaagtgttgaagaaatcgtagctccaagtgttgaagaaatcgtagctccaactgttgaagaaagtgtagctccaactgttgaagaaattgtagctccaagtgttgaagaaagtgtagctccaagtgttgaagaaattgtagttccaactgttgaagaaagtgtagctgaaaatgttgaagaaagtgtagctgaaaatgttgaagaaatcgtagctccaagtgttgaagaaatcgtagctccaagtgttgaagaaatcgtagctccaagtgttgaagaaatcgtagctccaagtgttgaagaaatcgtagctccaagtgttgaagaaatcgtagctccaagtgttgaagaaatcgtagctccaagtgttgaagaaatcgtagctccaagtgttgaagaaatcgtagctccaacagttgaagaaatcgtagctccaacagttgaagaaattgtagctccaagtgttgaagaaatcgtagctccaactgttgaagaaagtgttgctgaaaacgttgcaacaaatttatcagacaatcttttaagtaatttattaggtggtatcgaaactgaggaaataaaggacagtatattaaatgagatagaagaagtaaaagaaaatgtagtcaccacaatactagaaaacgtagaagaaactacagctgaaagtgtaactacttttagtaacatattagaggagatacaagaaaatactattactaatgatactatagaggaaaaattagaagaactccacgaaaatgtattaagtgccgctttagaaaatacccaaagtgaagaggaaaagaaagaagtaatagatgtaattgaagaagtaaaagaagaggtcgctaccactttaatagaaactgtggaacaggcagaagaagagagcgcaagtacaattacggaaatatttgaaaatttagaagaaaatgcagtagaaagtaatgaaaatgttgcagagaatttagagaaattaaacgaaactgtatttaatactgtattagataaagtagaggaaacagtagaaattagcggagaaagtttagaaaacaatgaaatggataaagcattttttagtgaaatatttgataatgtaaaaggaatacaagaaaatttattaacaggtatgtttcgaagtatagaaaccagtatagtaatccaatcagaagaaaaggttgatttgaatgaaaatgtggttagttcgattttagataat

SEQ ID NO: 356 - DNA, 2265 bp, Plasmodium falciparum
tcagaagaaaaggttgatttgaatgaaaatgtggttagttcgattttagataatatagaaaatatgaaagaaggtttattaaataaattagaaaatatttcaagtactgaaggtgttcaagaaactgtaactgaacatgtagaacaaaatgtatatgtggatgttgatgttcctgctatgaaagatcaatttttaggaatattaaatgaggcaggagggttgaaagaaatgttttttaatttggaagatgtatttaaaagtgaaagtgatgtaattactgtagaagaaattaaggatgaaccggttcaaaaagaggtagaaaaagaaactgttagtattattgaagaaatggaagaaaatattgtagatgtattagaggaagaaaaagaagatttaacagacaagatgatagatgcagtagaagaatccatagaaatatcttcagattctaaagaagaaactgaatctattaaagataaagaaaaagatgtttcactagttgttgaagaagttcaagacaatgatatggatgaaagtgttgagaaagttttagaattgaaaaatatggaagaggagttaatgaaggatgctgttgaaataaatgacattactagcaaacttattgaagaaactcaagagttaaatgaagtagaagcagatttaataaaagatatggaaaaattaaaagaattagagaaagcattatcagaagattctaaagaaataatagatgcaaaagatgatacattagaaaaagttattgaagaggaacatgatataacgacgacgttggatgaagttgtagaattaaaagatgtcgaagaagacaagatcgaaaaagtatctgatttaaaagatcttgaagaagatatattaaaagaagtaaaagaaatcaaagaacttgaaagtgaaattttagaagattataaagaattaaaaactattgaaacagatattttagaagagaaaaaagaaatagaaaaagatcattttgaaaaattcgaagaagaagctgaagaaataaaagatcttgaagcagatatattaaaagaagtatcttcattagaagttgaagaagaaaaaaaattagaagaagtacacgaattaaaagaagaggtagaacatataataagtggtgatgcgcatataaaaggtttggaagaagatgatttagaagaagtagatgatttaaaaggaagtatattagacatgttaaagggagatatggaattaggggatatggataaggaaagtttagaagatgtaacagcaaaacttggagaaagagttgaatccttaaaagatgttttatctagtgcattaggcatggatgaagaacaaatgaaaacaagaaaaaaagctcaaagacctaaattggaagaagtattattaaaagaagaggttaaagaagaaccaaagaaaaaaataacaaaaaagaaagtaaggtttgatattaaggataaggaaccaaaagatgaaatagtagaagttgaaatgaaagatgaagatatagatgaagatatagaagaagatgtagaagaagatatagaagaagataaagttgaagatatagatgaagatatagatgaagatatagatgaagatataggtgaagacaaagatgaagttatagatttaatagtccaaaaagagaaacgcattgaaaaggttaaagagaaaaagaaaaaattagaaaaaaaagttgaagaaggtgttagtggtcttaaaaaacacgtagacgaagtaatgaaatatgttcaaaaaattgataaagaagttgataaagaagtatctaaagctttagaatcaaaaaatgatgttactaatgttttaaaacaaaatcaagatttttttagtaaagttaaaaacttcgtaaaaaaatataaagtatttgctgcaccattcatatctgccgttgcagcatttgcatcatatgtagttgggttctttacattttctttattttcatcatgtgtaacaatagcttcttcaacttacttattatcaaaagttgacaaaactataaataaaaataaggagagaccgttttattcatttgtatttgatatctttaagaatttaaaacattatttacaacaaatgaaagaaaaatttagtaaagaaaaaaataataatgtaatagaagtaacaaacaaagctgagaaaaaaggtaatgtacaggtaacaaataaaaccgagaaaacaactaaagttgataaaaataataaagtaccgaaaaaaagtagaacgcaaaaatcaaaataa

SEQ ID NO: 357 - DNA, 771 bp, Plasmodium falciparum
aaatcatattatgtatataaaaaagacggaagaagaaataaaggaaagaaaatattaggtataagaattaataaatccttagccgaaatggatcatacaaaatatcacccagaatattatgatgaagttcaagaaaattatgacccttattatggagttaatcaatatagtgatgaatgtgaatcatacaaatccgaagatgatgattctgaagaagaatattataatagtacgcctcgtgtgactgtgttggaaccccaaacggagaatagtgaagatgaggaaaattatgaaaagactattgtagatgaacttaatgaattaccaaatgataaaaaagctttaatattatcttatataagaaatggaaatgataataatatgcaattattaccgtatgcaaataataataaacaaaatacccaagaaaatatatctcgtaataaagagttctttagacattttgtggatttcattaagggatataaactttttgattcacctgttttaaatgcattactaccctttatatttatagcttttgtatattgtacaatcacaatgttagtaggtaacgtacgttatattatagcactttatatattagcaaaaatattaaaaatgcattatgactacaaacataaagagaataataataataataacaacaataataataataacaacaataataataacaacaacaataataataataacaacaataataataacaacaacaataataataaaaaatcaaaaaaaaattag

SEQ ID NO: 358 - DNA, 768 bp, Plasmodium falciparum
gaattagagaaattaatgaaaagtggcactttagaaaaaatgaaaaaatctctcacctttttagtacatgtgaattcatttttacaattagattttttccatcaattaaatgaaccacctcttggattacctcgatcatatccattatcgttagttctcgaacataaatttaaagaatggatggacagttcgccagcaggtttctatttttcaaattatcaaaatccatatatcagaaaagatttgcatgataaagttttatcacaaaaatttgaaccacctaaaatgaatcagtggaacaaagttttgaaatcattaattgaatgcgcatatgatatgtattttgaacagagacatgttaaaaatttatataaatatcataacatttataatataaataacaaattaatgttaatgcgagattcaatcgatttgtataaaaacaattttgacgatgtgttattttttgcggatatatttaatatgagaaaatatatgacagctacaccagtatataaaaaagtaaaagaccgagtgtaccatacattgcatagtattacaggaaattctgtcaatttttataaatatggtattatatatggatttaaagtaaacaaagaaatattaaaagaagttgtcgatgaattgtattccatctataattttaacaccgacatatttacggatacttcctttttacaaaccgtttatttattatttagaagaatagaagaaacctataggacccaaagaagagatgataaaatt

SEQ ID NO: 359 - DNA, 858 bp, Plasmodium falciparum
atggtttcattttttaaaactccaatctttattttaattatctttttatacttaaatgaaaaggtaatatgttcaataaatgaaaatcaaaatgaaaatgataccattagtcaaaatgtcaaccaacatgaaaatattaatcaaaatgtaaatgataatgacaatattgaacaattaaaatccatgattggaaatgatgaactacataagaatttaacaatattagaaaaattaattttagagtctttagaaaaagataaattaaaatatcctctccttaaacaaggaactgaacaattgatagatatatcaaaatttaataaaaaaaatattacagatgcggatgatgaaacgtacatcatacccaccgtccaatcaacgtttcacgatattgtgaaatacgaacatcttataaaagaacaatcaatagaaatttacaattctgatatatcagataaaattaagaaaaaaatttttatagtaagaacattgaaaaccataaaattaatgcttataccattaaactcgtacaaacaaaataatgacttgaaatctgcactcgaagaattaaataatgtatttacaaacaaagaagctcaagaggaaagcagtccaataggcgaccatgggacattctttagaaaattgttaacacatgttagaacaattaaagaaaatgaagatatagaaaataaaggagaaacacttatattaggcgataataaaatagatgtaatgaattcaaacgatttcttttttacaaccaactcaaatgtaaaatttatggaaaatttagatgatataacaaatcaatatggattaggtttgattaatcatctaggtcctcatttaatagcc

SEQ ID NO: 360 - DNA, 768 bp, Plasmodium falciparum
gaattggagaaattaatgaaaagtggcactttagaaaaaatgaaaaaatctctcacctttttagtacatgtgaattcatttttacaattagattttttccatcaattaaatgaaccacctcttggattacctcgatcatatccattatcgttagttctcgaacataaatttaaagaatggatgaacagttcgccagcaggtttctatttttcaaattatcaaaatccatatatcagaaaagatttgcatgataaagttttatcacaaaaatttgaaccacctaaaatgaatcagtggaacaaagttttgaaatcattaattgaatgcgcatatgatatgtattttgaacagagacatgttaaaaatttatataaatatcataacatttataatataaataacaaattaatgttaatgcgagattcaatcgatttgtataaaaacaattttgacgatgtgttattttttgcggatatatttaatatgagaaaatatatgacagctacaccagtatataaaaaagtaaaagacagagtgtaccatacattgcatagtattacaggaaattctgtcaatttttataaatatggtattatatatggatttaaagtaaacaaagaaatattaaaagaagttgtcgatgaattgtattccatctataattttaacaccgacatatttacggatacttcctttttacaaaccgtttatttattatttagaagaatagaagaaacctataggacccaaagaagagatgataaaatt

SEQ ID NO: 361 - DNA, 1260 bp, Plasmodium falciparum
atgtctataagaaatagagataagaattatatgagtcatgttaatgcgggtaaacatagtatgaataaagtatcaaataataatagtaatagtaatataagtaataataattattctttagggttatatattgataatccacagaaagcatttttatttgatgaaaatgatttaaaagaattattttcttattataaaggagcacatgatataaggatattagctgataaagcagcagctcaaataacatttaatgataaaaatatgatacaacaagtaaagaaagatataaatggattaactattaatgatattggtactataagatgtataatattaaatgaggggaaagtaattgaacaatttttacctttctcagcaaatgatccaaatgttacatcagaaaatgataatactgtttcaaataatgagagtactgtaaatatgttaaagaaattatcaagtttgataaatacaaacaataataataataataataataatataaatagtattaatataaataatattaataatgtaaatagtaataatggtaacaagaaatgggatatgaataatagaattaataatataaataataataatataaataataataataatattagtaataataataattttaaccaattaacaaataataataaaaatgaacaaaatgataattcttttgccaataaaaagctgagcagaattgaacttattgatatttttggatttcctaatgaatttgatgtaatgaataaaatactaggtaaaaataattcaaatataaattatattaacgaacaaacaaataatatggtaaatatcgaattaaaaggaaaaccaattaatgaagctccagtagttgaaagaatgcatttgtctataacatctgataatttgaatgcatataaaaaagccatcgatttgattatgaaattattaaattcgctttttcaagaatttgtagatttttgtcttgaaaataattttgttttaccagaaaatttgtcttttaaaagacatgaatatatgtataattcagatggttctacgaaatatttaggttttaaggaaaataattatggggaaaaagaaatctacaaaaatgatttttcttataataagaaaaataaaaacatgccaaaaagtgataacgataaaaggaataacaacaataataatagttcatttaatatgaatataaatggtgcatatggtaataaccaaaatgtaaaaaatggtagattctaa

SEQ ID NO: 362 - DNA, 1194 bp, Plasmodium falciparum
atgatgagaaaattagctattttatctgtttcttcctttttatttgttgaggccttattccaggaataccagtgctatggaagttcgtcaaacacaagggttctaaatgaattaaattatgataatgcaggcactaatttatataatgaattagaaatgaattattatgggaaacaggaaaattggtatagtcttaaaaaaaatagtagatcacttggagaaaatgatgatggaaataacgaagacaacgagaaattaaggaaaccaaaacataaaaaattaaagcaaccagcggatggtaatcctgatccaaatgcaaacccaaatgtagatcccaatgccaacccaaatgtagatccaaatgcaaacccaaatgtagatccaaatgcaaacccaaatgcaaacccaaatgcaaacccaaatgcaaacccaaatgcaaacccaaatgcaaacccaaatgcaaacccaaatgcaaacccaaatgcaaacccaaatgcaaacccaaatgcaaacccaaatgcaaacccaaatgcaaacccaaatgcaaaccccaatgcaaatcctaatgcaaacccaaatgcaaacccaaacgtagatcctaatgcaaatccaaatgcaaacccaaacgcaaaccccaatgcaaatcctaatgcaaaccccaatgcaaatcctaatgcaaatcctaatgccaatccaaatgcaaatccaaatgcaaacccaaacgcaaaccccaatgcaaatcctaatgccaatccaaatgcaaatccaaatgcaaacccaaatgcaaacccaaatgcaaaccccaatgcaaatcctaataaaaacaatcaaggtaatggacaaggtcacaatatgccaaatgacccaaaccgaaatgtagatgaaaatgctaatgccaacagtgctgtaaaaaataataataacgaagaaccaagtgataagcacataaaagaatatttaaacaaaatacaaaattctctttcaactgaatggtccccatgtagtgtaacttgtggaaatggtattcaagttagaataaagcctggctctgctaataaacctaaagacgaattagattatgcaaatgatattgaaaaaaaaatttgtaaaatggaaaaatgttccagtgtgtttaatgtcgtaaatagttcaataggattaataatggtattatccttcttgttccttaattag

SEQ ID NO: 363 - DNA, 2559 bp, Plasmodium falciparum
ctattgaatgaatacaatacaattgacgaccctgataatctaaataataatattaataggaataggaatatatatatgcataaaaatcgaattagcaatgaacaaaataataaattcaatcttaataataatgaactggaggcagacgaaaaaaaaaataaaatggataacatgttttataataaagagagaaattatttaataaataatcaagaatataataaaaattatatttatagaaatgaatattataaaaacgaaaaaaatgtatatcttgatagttatccctacgaaatggttgaacacaaaaacaaatacacatctaacatgaataatcaatatgataataaagattcttcttatttatatgatgatgtttcttcatcttttaataataaaaaatatactaaattaataataaaggataatttgtgtaacaataaatataaacataataattatgataatcataataatattgatggaaatgatgtatattacaaacatccttatggtatagaagaaggaagggcatatgataaaaattattatcatgataatgaattaaatgatcaccatttaaattataatgataactacatgaatacaaaagttaatatacatgaagatcataataataatatggatgataaaaatatatcatataataatatgaacctgacggatgaaaataataataataataatgataataataatgaaaaatataatgatgacaataataataataataatagatatcatgtaatgaatcaaagaaatatatatccaaacaatatccctatgaaccatgttggagatataaatgaagataaaaataattataatatgtcagataaacaaaatatcccatctattgatgagaaacgagaagaaaattcaagaaattttataaacgaaaccaataaagatgataaggaaaatgtaaataatatgaataatttaaatatggtcaataataatatgaaaaattttatagtaccaaatatgaatggaatggttcttcaaaatacaagtgtgccagctaatgtggtaccagctaatgtggtaccagctaatgtggtacctgctaatgtggtaccagctaatgtgataccagctaatgtggtaccagctaatgtggtacccgctaatgtggtaccttctaatgtggtacccgctaatgtggcacctgctaatgtggtacctgctaatgtggtaccagctaatgtggtacctgctaatgtggtacccgctaatgtggtacccgctaatgtggtacctgctaatattattcctgcaaatattgtccctacaaatatagtgccaaatgtacccattacaaataataatattcaaaataataataacttggaaaacatcaacaaaactaatgataacccagcaccacctgttaaaagaaaaaggggacgacctaaaatgaaaaaaaacacaccggaagaaacacaacctactgatttggctagtaacagtaatgcttcttcatcatatcaagctactaatacaaatattcaaaatatgaatctaaataatttgaatcataatctcgtaaatgatatgaatcaacctttatatactaatcttaatacaattatcaatcccccatttaataatcaactagccaatgctgttataaatcttcctttagatcagcaggttgtacaaccattaggacaacaagtggggcaaccccttggtcaggcaataaattatcaggtaattcccccacctcagacaataggacaacagctagctgaaccgatcaaccagcaattgaatcatcagctaagtcaacaaatgaatcagcaaatgaatcaacaaatgaatcaacagataagtcatcaaatgaatgctcagttagatcaacaaatgaatcatcaaatgaatcatcaaatgagccatcaaatgaatcagcaattaaaccatcaaatgaatcagcaattaaaccatcaaatgaatcaacaactaaatcaacaattaaatcaacaattaaatcaacaattaaatcaacaactgaatcaacctttaagtatgaccatgaatcaaccattcaatcatcctgctttatataataatacaaataagccattgaatccttccttatacgtagtatctaatatgatgaacaataattataatggaaacttgacggaagagcaaatgggaccaatgtttaataatcatgataacgaacaaggaaataatttggatccaaacttttattatagaaatatggaacaaacgaaaagtcaaaacgatgatttttcttatgaagatgaagaagagatgaaccgaaataataaaaagaatacaagatcctctgtaagtgaatcagaaggacaacattctgagaaagaatttccaaaaattcataaaagaaggggaagaagaagaaaaaaagatattgagcagtattctaatgaatttaaacaaaataataatcaagataatataaatcaggatactagagaggagaataaaagtgatcctggatattcaacttttattgatgaaaataataagacagtttcatacaga

SEQ ID NO: 364 - DNA, 2775 bp, Plasmodium falciparum
atggatggtgatatatcaaggaagagttatgtagaaatattaaaatattacagtaaagatgagaataaattaggaggacataattttgggaagaataaaaaaaaggatttaaataaatatgatatatattataaagattatttatatgattactataaagaatgtaataataatattaataataatagtagtagttattataataaattcaatacagaatatacagattgtttaaaaacagataattcatttttcatgacaactttaagtaatttaaaaaaagataatgatgataatgatgtagattgtattaacaaaggtggtagttatagtagtaataataataataataatttttgcttaaatgttgaaatgttgttttcttttttattttgtaaaaagaagaattatttttataatataaaaaataaatatttcaatgaaaaattttatcaaaccaataataatattaagaagaaaagaaagaaaaaaaaaaaaaaaaaaaaaaaaaaggaaaaaaaaaatgtacatgaagataaacaaatatatgatgaatatgatgatgaagaagaaaataaaaataaatttttatataatataaaaaaatatcaaaaaaaaaaaaaatattatattaataaagaatattattatgttaaaaattattatcatgatataaagaaaaatattaaattagataaacaaaaaaataataatacatgtactatatgctttattaataataataataaatatatagaaagatgtacattatgctttgtacattttcatgtatattgttataaaacatattgtgatgattttaatttgaataattttatttgtgatttttgtaaatataatataaaacataatcatatatataatgaaaacaaatataaccaaacaattcataaaacaaataataataattatagatataattgttttatacaaaaaaaaaaaaaaaattcttatatgaatcaagattcccttttttcaaattatatagacagctcacatgaaaacgattataaaaaatattcttttgcctatccatataattataatatgaataaacaaaatgatgatgaaaattctaaagcttgtcaaaatatgaattcctatgatgatgaccaacatgtgtgtcatttaaaaagaagaataaaaaataaacataaatggttttgtaaaaaaaaaaatgtatttgaatatttcacggatcatgattttattagcacaagggaatatcttaataaagaagggggtgatgagaaaaaaaataaaagaaaaagaaaatatataaaatataacacaaaagggaatacaaaagggaatacaaaagggaacacacaagagaacatacaaaataacacacaagagaacatacaagaaaacatacaaaataacacacaaaataacacacaaaataacacacaaaataacacacaaaataacacacaaaataacacacaaggaaacattaaggataacattatatatcacatgaatgatcttattaataaccacattagcgataatacacccaatcacatatacaatgtacagaataaagaacatccgttttgtagtgagtacattcccatgtatgataatgaatacttttccgaaacaatttataataataataacacacatttaaacaaatgttgtaatatataccaagaggaagaaaatatgattaatagttttcttttaaaaaaatctagttttaataaatattgtgataaatcaaataattcactaaaaagaaagtttacagatttatcgaaagataaggagaaaagaatattttgtatgatatgtaaaaatatgaatacaaatgttcttatgaaaaagaaaggaaaggatgagtggtaccatgtgtgttgtttatattataataatattacaagaaataattgtatatatcatatatatgtagagcatttcttttttaatcattataatgaggattattttgtaaatatgtttggaagtttaaaatatattaatgaaattataataaaaaaaataaaagatgaattattaaaaaattataatattctcgcacatagtcatttctttaattttcttatgaatccttattattataatttaacatttaaacaaatcaaaaatttaatcttttcaaattttattttaaataataatacattgtattcgaattatcagtctttatcataccagtccttaaatcaaacacgtagaaagagaatagaggaaagtagaagcatctcccaagggaatcataatgaaatatatggagcaagcataaagtgtgcgcaaaacggtgtacgtgataataagttggatgggaatcacgacaatgataagaaggatgataataaaaaggatggtgataagaaggatgataataaaaaggatggtgataagaaggatgatgataaaaagggtgatgataaatatgatgatggtgatgataaatatgatgatgatgataacaaatatgatgatgatgatgacatatatgacgatgatgatgattttaatttcgatcatgacagcgaaacgtcgaaaagattatcaaattacgattcccttttaaaagataagaaaaaaggatccatattaaaaaaagaagatacattgaagtgttctaaaatgataaatgtacaagaaaaagaaaaatcatcaaaaatgtattgcatgaatactaataattgtaatgtcgttaaggaaaagaattattttgtaaatgattatatgcatatcataaacaatcttagtgatcat

SEQ ID NO: 365 - DNA, 2775 bp, Plasmodium falciparum
attttaaacaacttgggtctttatacttataatttaaaaaataataataataataacgtatatatgaagacaataaaattaacgttatgttgtacacatagtaatgagcatgatacgaaagctgttatgaatattaaattaaatactttgaacaataaaaaatataataatataaattgtattttttatcattattataactcctttttacattccttattttattcagatgaatatattgagcttataagaaaggaggaacgtaaagaagatattgaaaaggaaaaaataaaaagaggcaaatattgtcatcaagaagatagggatgataacatgaataataatgataataatgataacaataataataatgataacaataataataatgataacaataataataatgataacaataataatgataacaataataatgataataataattcgggtgaagaccaattaataaatgaggataacaaaaaaagaaaaataaataatttatcgacccatgaacatacacacaatatgagtgatcataataaagaacccaagaaaaaaaaaaacaaatcaaatgagacacagataaatgatgatactaataaaaaggaaactcataaaaatgaaatagatcataaagaacaaaaagatacaaattgtgataatggaatagaagaaaaaaaagaccaagtatctaaaagtaataatattataagtaaggtgtttcatttttttgaaaggaaaaataataatattaaaaaagatgagcataaaaaggaatacaatgaaagaaatgataagatgagtgaatgtgatatgttattacaaaataaaagagataatgatcataataataataataataacaataatgatgatgataataataataataacaacaatgatgatgataataataataataacaacaataatgatgatcataataataataacaacaataatgatgatgataataataacaacaacaataatgatgatgataataataaagatcccacattagatggagaaactcgttcttatattgatgaaataaatcaaaaagaaataaatatattttctaaatatatagataaaataattgaaaatgttgaaacgaaatgtattatgaaaaataacgtttgtgatggtatttattatttaattagacaagaaaatggtttgaatatttgtcagaaagttaataacaatataataaaaaacaaaatgaagcaagaaaagttttataaaaaaaaaaaacaaaataaaaataatcacaagaacaagaacaagaacaagtacaattatgatataaatatttttaataatgttcctgtggatatacaaaaaagaaattatataaatactaatattataaacattaataataataataataataatagtaatagtaatcatagtaatcataataataatagtaatcatataaacctaagtgatttaaaaaaaaaaattaatattaataaatatacatacttattctatcgtcttcctttatttttatttggagataaatatattaacgatatagatgatgtcaaaagcatttatatgattaaaaatttttttaatcaatataatgatgttacaaacacatccaataatattttgtatgttatagatttattaaaaaaatataataccaaccataatattttaaaaaaaaataatatgatccagtcaccaaagaattatatttgtgaaaaagaagaacaatctaacgatcctgcaaaaaatactcatgtaccttttaatcataatgcactggacacatcacacccaccagtggatacaacaaatacaaatttgttgagtgatgttaatatagaaacaaatgaaatacaggagcacataaataataacatccgtaatgatcataataatgtaataaacaaccaacaaatggaacctaaaaataataatactcctaatgaggaaaagattattttagaatcgacaacgcaaaggagtgaacaaagaatggaagaccgtgatgaggaagatggtaaaagtggagaagatactcgtttggtagatgtagaaacgaaagtggtagatgtagaaacgaaagtggtagatgtagaaacgaaagtggtagatgtagaaacgaaagtggtagatgtagaaacgaaagtggtagatgtagaaacgaaagtgacagatgtagaaacgaaagttacagatgtagaccacaaaatggtagatgtagaaacgaaagtgacagatgtagaccacaaagtggtagatgtagaccacaaagtggtagatgtagaccacaaaatggtagatgtagaccacaaaatggtagatgtagaccacaaaatggtagatgtagaccacaaaatggtagatgtagaccacaaaatggtagatgtagaccacaaaatggtagatgtagaccacaaaatggtagatgtagaccacaaagtggtagatgtagaccacaatgtggtagatgtccaaactatagatgcaccaaataggaagcctataattgacgattgcatgaaaataaaaaaaatgaaaaagaagaaaaaaagcgaaacgcttgttcaagagaacgagttgtcttgttaccctaataagaatgtaaatgtaatattttctttatttgacaacggtaacaattgttatttgttaatatatgaatccgagaaagataataagaagaagagtggtaaaaataaagcactaaaaacaaagaaggattataataatatagattatttttttaaggatttatatcac

SEQ ID NO: 366 - DNA, 1749 bp, Plasmodium falciparum
atgcaaaataataaaagaatggataattataattgtagaagttttaaaaaggaagaatattataaaaattattactataaccaggatcattatatgaacaataacaataataatttatacaataaatataattcatatgatgaggaatatacatataacaaaagtagtaataaaaagaatttattatttaattattataacaaagaaagtattggacataaaaaaaaaaaagcgagttttgtaaaagcacaatatgctaataataggataccatctaataatacaaaattaaataatatgcgtgacaaaattaattataataaaatggattatgattatattttaacaaaaaagaaaaaaaaaagaacaagcattgaaaaaaataataaacataatgacatgataggagatgtttattacaaaattgcttattatttaaaaaaaaatagaaaatatatgcaaagaatattaaaaaaaaattatgtcattaaaatttatttagtgagacatatggaagctttacataatacagaagtaataaaaaattcaacgatatctagagatatgatttatagaaataaagatttttttgattgcccagctagtgaagaggggaaaattaagtgtgaacaactcaaatcgaaagataataaactttatcaaaaacttatcaagttgtataatgaatctgttcatggtaaggatgaacaaacaggtgacattaacacgaaccatcaaaaatataacactaaaaatataaataataatcacaataataataataataataacaataataataatcacaataataataatcacaataataataatcacaataataataatcacaataataataatcacaataataataatcataatatttatagtaatagtctacataataatcaaagttataataatcttcgcattaatgaacatgccaaaggagccttcgaaaaaaataacaattttgttattattacttcacctttaagaagatgtcttgaaacaacaaaatatttcctgaattttaaaaaaaatattattgtttatgaagctgtcagagaaactgcaggaaactattatagtgatcaaagatcaaaaacgtcagatattaaaaaattctgtgatcagaattttgaagattacgaacttatttgctttggtgaaactgatgccttatcaggaaataaatttagagaaacatccgaacaagtctattgcagatgtttacaattcttaaaattaatacatgcattagctatcaattattttgcatcattagaaaaaatcaacgaacaagaagaaataaataataaaaattttgaaaatatcaattcacaaacatgtactaatgatattgatgaaaatgtggaaaacgaaaaactttgctcagctagccaaaatgataattcttttgaaaataaaggtaataaagtgataaataacctgaacaattcaggtaaagtaaatgaaaaaaaaaaaaaaaaagctgaaatgaaggatgataatgaaaaaaaagaatttgatgagaataatataaaagaggaggaggaggaggaggagtacgacaacgacgacgattttactgttgaaaataataaatatgtggacgatgaaaaaatgaatgatgagatggtaaaaaaaccgaaaaataagaaaggtgtgtataatgttgtgatggtttctcatagttcctttatagttcatatgttagctttattagattatttagatttggat

SEQ ID NO: 367 - DNA, 1746 bp, Plasmodium falciparum
catagttcctttatagttcatatgttagctttattagattatttagatttggatttccgaggattaaataattgtgatattagaaaaataagtattccattgagtcattcttttttattttataataatataacgaatttacaaatagcacgtccattatcaataaataatattcctataagttacatgaataaaaataaagcattaaaaaaggcttataaagataaatatatatatacaataaatagttatacagaattagatgacctcatatgttcacaaccatgtaccgtaataatatatcaatatgatatgcttataaagaatgaaaagaataaaaaatatttagacagtgtacaaaagtttattgataacagtaataattattatagtaactcgaataaagaaaatcatgtgtattcaaatggtttatataaaaattatgttttaagaaataaacgtttaggtcgcaatgtgttaatatatgatggtagtgaatatctcatttatgtaccagaaaaaggttcatgggaaaacaataaaaaaggatatatagttggtcagaatattattcttgtggtattaccagaggtagaatcgaaaattataaataaagaaaatgttggagaagaggagtatgtatctttgaatactaaaaataaagaacaaaatgaaaattataaaaaaacatcacattatttacaaaatgtaattgaagttataaagaattatgatagtatacaagatctaataaaatcaattgatttctggattaccttaaaagaaaatataaaaaatatagatatacctacgtttcaaaaatatttgattgaaaaatataataaaattataaaaaatgaaatggatgtatgttatgtggatattgttggatgtatcgagaacgaagaatttatgaaaaaaaatgagcataaatgtaatggatatttgaaaagtctaaaagaaaaatatgaaaaaaataatgatataaattttgaagaggagtgtaaatatattaacgaaaattttatagaagaaatatttacttctgattattcttcaccaaatttagatataaaaaatgaaaaagatatatcaagtgataataaaaataaaaataaaaataatgacaacaataataataataataataataataatgatgatgattttcataataataatagttatatacaaaataatgacttccttgaagaaaatataataagaaaaaaatttatttatataccaaaaaatgatagtaacaatataaaaattcaatccaatataaaacaaacatataaagatgaaaaacaaaataaaagtttccttcaagaaaatattaacatattaaaatcttttccacaatctattcaaaacttaagtgtagaaatgttttatcgtgataattatttttatttccattgtttaaataagtatattaaaagtaaaaacaaaatcgaaggtttaattatttgtaaattgttgacatatcttgatcttttaagatcatataatacacatggattaaataaaacatttcaaagattaatgcatatagaagaaaaaatagataacaatactaaaggtataggggaaacacttaatacatattcttgtgatataaaccctgtgcttgctaataatacttcctactatggagaaggaccaaaaaaatataagatcatttattcaataccaggcaagaaaattaaaaaaaataaaattaaaaaaaataaaataaaataa

SEQ ID NO: 368 - DNA, 2304 bp, Plasmodium falciparum
cttactcaagaaggacatgataccgatggaatcacatcattcggagtatcacccctcatgaacaataataatatgtatggtaataattatattcataataatgtgtattatccatgtaatggaataaacaattattataataacaatgttgtgaattcacaaaataattatatgatgaaaatgatcatgtcaaattattattctgaatcatttttaaatttaacgagtgggaaaaattatccagatattatagaaaaaataagaaataaattattatataaatataataataatgttgaaaaatctatttttcataatttttataataatatccttaatttaatacaacctgttaatgcaatagtacctgtgtattcaaataaatatgatgaaattaataatgcttctatatgtacaaatattataaacatgttttcgaatggaaaatggatatttaccatgccattatttaatcctaataaaaggaaatgtgaagtgagtgaatattttaatcataaatatgaactgaaaaaaccaaagcatttatttttagtaaagtggatgtttttaaatacagataattataaaataaaaaaaaacaaacaaaaagaacatgtaatggatactaataatgctcttgtaaataataattctttaggtaaaaatgtgagcaaaaatgatattcatagggataatataaatgattattctttgaacgaccaggaggatcaacaatacaataagggatattactatgatgattatgatgattatgatgattatgatgatgatgataataatgatgataataatgataataataataataataatgatgataataataataataatgatgacgattatttaagtaatgtaaaagtcgagagtgataataataatactcatcagaataatcctgatgggtatgaaggtaatgattcaagttccatgtgtagtgataataataaaaaatcgaaacaaaaaaaaatgaaatgtaatttgaatttcagatcagtacttggatttttatccatgtgtccatttaattttgatacaaaaagaaatatatatgataatcaaactgcagatatatatgctgtatgttcaagtattgattatagttatacgaatgatacttatacatgggtaaattatgttacagtgcttccaaataaatatttcctaactttctttttatcatccattccttatcatgataatgtaattattcaaacaaggacaaatctatatacgtctgatatattatctataaaaatatttgattcaaaagaaattattttaaaaaatatgaaaaaaatgaaacataaaaataaaacaaatacaaccaattattatgatactaattcgacaatcaataatccaaatattaccaagcatgatttgttgagagtaaattatcttcgttatgtcatgtccaaattattattatccttaactttgtcttttaatcgtcaggaaatcgagcaaaacacgcaacctcttaaattaagtgaaaagagtaaaaggaaaagtgtcataattaataaggatggaccaaataacgacaacagggttgatgcgaatgataaaaatgttaatggtaatgataaaaatgttaatgataatgataaaaatgttaacagtcaagataatcagggtaaccaaaaagaccattttgatgatgaagatgaagaatattttagtgacgaagatataatgagtgatatagaagaaaataatattttaaaggaaaatctctatttaaaacaaatagttataaatatgattgaagaaaataatatggattatataaattataataaatatagtatggataatatggacatagatgaacattttaatttacaatatttatatgaggatgaacattttataaatctaaatgaaaaatggtataataacaaaggagaaattttaatgaatacatatgattatttatataactctttaaaaaatgaaaatgattataatcaatataataacaataacaacaacaataacaataacaataataacagttcttatatggttaaaaatataaaagaaaaagctttaaactccttagaagctgttaaaagtagttatctaaataataacttttctgtacaagtacaaaatacaatgaatgcttatgaaagaactaattctgaagattttctcttctttcaaccaataaacatttctcctattaaagaagcaaattacaaattaaggtccatgtattataatgaagtagcacctaccctggacaaatttaggagaacaaatcgacaagtgtaa

SEQ ID NO: 369 - DNA, 684 bp, Plasmodium falciparum
atgaagtatttaacatttaataaaaataacagagatgctattgatttgagtgaaaaactagaagctactaaaatagatttatcgaatcccttattattacaatataattgggtgatatgggaacaagtatcagataataaaataaaacaaagtaataattataaggattatacaagaccactagctaaatttaatagtgttcaaaaattttggcaattatggaatagattacctcaaccaagtgatttactggcacaaagaagtatgaccagattttcagaagatggaatatttcgtattgttgatgctcttatgatatttagagataatatacaacctatgtgggaagatccagcaaattcaggcggtggtcattttgaatataaaatattacctaaggattatccatatagccaaattgatgaattttggaataatctcgttttagctataattggatgtagtttaaaacattatgatttaataacaggtattagattagtagataaattaagtactacaagatatggatatataagaatagaaatatggtatactactataactgatgaaagtgttaaaaactatttgagaaaagatctagaagaacatatgtgtaatcgtattgatggatcgactatatttccaccaagagtaaaaagtcttagtcacatacatagataa

SEQ ID NO: 370 - DNA, 1386 bp, Plasmodium falciparum
atgaataagatggctagcactcataacgagattattccgcgacttggttttgaagaaatgaggaacgaaatgaacaaatacggtgtggaaataaatcagagtacgttaaaaaacccgagcacagaagatatacaagggatatatagtttatgtataaaatatatattaaataaagatattcagaatatacgaatagaagagtatacaggagatttaaaaagttctttacccacagttgatggtttacagatattaccaaatgaaggtaagaatcatttacaagctattggtaatttaagatttcttcgacattgtgaaaagattaataagatattaaatttagataatattttaagttatatttttaagccagtaggtagtcatatgacaaaattaataaatgcatttatacattttatgaaatatcgcgatcaattatataatgagaatggtgaaaagataaaaagtattcaagaaaaaaagaatgaatatgatgttttagaaaatgaatatgatgctttagaaaatgaattgaataaattacttttaaaacatgaggacataaggaataatattattaatgaaaagaatattaaaagaaattatgaggaagatattataaaaaatcaaaatttattaaattcacaacagagtcttataatatctttaaattcaacaaaggataaaatcgtaaatgaaacaaacgagttaatatttcagtattcaagatatagacaaaaaaaagaagatttagaagatcaaattgtgccatcacccgaaaaattacaaaaatataatgaagaattaaaagatcatctttatgaacatatagctcaatttgaagatgatagaaaaaaaaatgaagatattaaaaataaaatcaatatagctgatatttgtataaagaaattagttgatttattaacggcattaaatgaacatattgaacatacaattaaattacatattgaaaaaaaaaataatcttcaaaccatagagaaacaatataaatctttaacaaatgaaaaacaaaattttataacaaaaaatacagaacaagataaaattataaaagaaacaaaagaatttctacagcaagaacaaacaaaatggaaccaaaaaattaaacaagaacaacataatactatattaatacaacaaaaagtaaaagatatatatcaaaatgttgatgatcttaatattaaaactaatagagaaattaaccaaattaataatatcattaaacatatacaagatattattaatcattataataaaaacatccttctaataactgaacttatacaaaacacgaaaaattctcacagtatacttacacacaaggtactcaacaatatacaaaaggatatcagcgcaaacatgtga

SEQ ID NO: 371 - DNA, 2844 bp, Plasmodium falciparum
aaattagataaggagaagaaaaaaaatgtaatagaattaaaggaatatttagaagatttgaaaaaaagaatgtttgatatgcaaaaaagattgaacgatataattattactaagtctacttttttaaaaaacgaaagtgaattaaatatgaaattgtttgaaacaagtgctatagattatgttaataataatagtaattttgaagttttttcaacatacataataaatgattttatgttaaacaagaagagaataaatgttttaaattatgacagcaatttattttttaagaataattttatgtattttaattttttacataattatttgaaagaaaaaaaagatgaacatgttttaaatgtttatatatatttaaaagatcctcttattcaagaatatgaattaaattattttaattattatgttgttttagatttgtatatattagatgttataataaaaaatgtagatttattaatagaaaagaaagggaagaaaagaaaaaatgtgaatcatatcttagtatgtatcgataattatgttgtaaaatataatgtactatcaagtaatatatatttagatattcaacaagatatcaaaagtttttttcatgaaagtaatcgtaatgttgatggaagtaaaatacaagatatgctttttcattttgaaagaaaaaataattctatttatcaaaataatatgtttcatgataaatattataaaaaaaaaataaagaaagatataaaagaagaaaaaaaacaaaatgatagtttacaaaaatataataaaaatatagatccattattatttattcgaaaaaaaaatatcttttttgattcccagaaagaatattataaaaaatttttatcttcttatacatatgaagaaattgtaaatattttatgtaataaaagttcaagatgtaataacagaatttttcaattaataaatgatgttaataaaaatacatttatattaaaaagtcatctcgctttaaaaaatgaattaaaaaaattctttcaaattaatcaaaataaattattgaagaataagacaggtgttggattaattaacagcactaaggatgatataaatcgcataaccaacatgaatcttgcaacaaatacaaataatgctatgggaaatataacaaatgattctaatattattaatacaaataataataataatacaagcgatataaataataataatacaagcgatataaataataataatacaaacaatataaataataataatacaaacaatataaataataataatacaaacaatataaataataatacaaacaatacaaataataatagtaataataataataataataacatttttaataatgaagattcattaaataaatgcagtgcctatacataccccttctctaatgatgccgaaaaaaattaccaggaaaatagaaatcaaagtttttcaaacagtgatcactgttttaaattattaaattcaatacaaggtgctaataaatctagcgattttattaatatgcaaaacattgatgattatttaaatacatactatgtagcctatcatgaatcatttaaagttgttaaaaaagaacactactattccgtcatttctcatatctttgaaagttatttaaatatagatgaatcttcgaatgatgatgatcatcctattcataaaaaatatccccacttaaaaggtagaaatgtatccatcaattttttgggtcagctacctgaaattatgaaggtttataaaacgtttcgttattgtgattcccttaatgttttggcgaaaagctatattcctaagtcccctgcaagtgttcaaagtttagacaaaggggaagataataatgataatgatgaaaaaggcgaaagtggagaggacacacaagtgattgaaaaggatgatagtggagaagacagacaaatgattgaaaaggatgatagtggagaagacagacaaatgattgaaaaggatgatagtggagaagacagacaaatgattgaaaaggatgatagtggagaagacagacaaatgattgaaaaggatgatagtggagaagacagacaaatgattgaaaaagatgatagtggagaagacagacaaatgattgaaaaagacaaaagtagagatgataataaagctcaaaataataattctacagataatgaagaacatgacgaaataacagaacagattggatttttaaaaaatcataatcaaaaatatatgcgactatttcaaaagcatttattagaggaaataaaatttattaatttttttgaattccttgtacagaaaaaattaggagttatattagagaaaaatgaatttttgaaattatatattttttatggtcaaaaaaatttacctagcatgccatatactccacttttttttacctgtagaacaattattaaaatagaagtattaagagatgttaatacaaatcaaatcatttattctagtagatctttctttttagaaactttaataacattaaaagaatataaaattaaaaatgaaagtgcatatattgttattgaaactacagatgaaagtagtactattaaaaaaagattaaaaatggatatgttacataaaatatcacccatgtcacatattaatgcatatgtcatatctaataaaggaaaagaaattgtttatcataaaggtaatatatatcaacgatcagctagcgatatcaaaaatgttataagtgacataagaaatgatttcttaaatattattttaccacaatatcatttatttgatttatttgataattatgtttatataattatatgtttaaaaaatgaaaattgttag

SEQ ID NO: 372 - DNA, 2370 bp, Plasmodium falciparum
atgcattttgtagttgaattggataatacaggtgatgattttaatgataaggctatatccattgaaagatttagaaatgtttttgaggtttatgttgaagacaaaatagatgaattagatacaaaaccatcagaaatacttaataaagaatgtcgacattttaattattttattgatgatatgaaagatgagtttctcacgtcttcattaatacgtctccccaaaaaattaagaaagcaattatgggaaagtgaagttgatgaaaatttaccaaatttaatggctacaactacacataataagtgtctaagaacagaacataattatgataaaaagtatagggacgtcattaaaatattagaagattattgtgaagatagggctactaaattgagggatttaaaagccataaaatatgcagaacaggattgtattaattttaatacctgggtaagtagttgggactatgaaataaaaaggcaaatgaataaattagatatttcaaaaataaaacaatatttggaaaagtcaaagttcaaatgtgatataaatgatttagataatttagatacatttttttcccatgtaaatccaaaagatatgaagggaagtgaagaggatccaagaaatcctcaggaagaagagcacaaaagagatgaatatcaagttttaaatagtacagttgaagaaggtgatgaatatgttgatagaataaatatcctttctacagaaacaggcgaagcgacaccaaatattcaagaagaacctttaagggttactcctcatggaggggataatcatgttaaaacacctcctacaattgtaaagactgaagtaggtaatgataatcgagagaatgtagtttctactgctggtaaaagattaaatagaggtaaaccaaataaagatggggttccacatacatctagatttaaaacacctaaagttagtgcacctgctggagggaaaaaatctaaaaatgcaagagatagtactgaaccaaaacatcataaggaaaaaggaaaatatgataggattaaaaaaacaagcgaacaaataaataaatacgctcatcctaataataaatatactatctttcagtgtactgatttagattgtaaatggctgaaacctaaacatattaaatatccatatgaaggttatgatatagttgataatgataaacttgtagatacaggaaagggagattatgaagatcatcatacatattgttctggagatgaatgtgcatttggtaatgctgttgggggacagtttgacgaaagcagatctcaaggtaagcaaagaagaaaaaaagggaaaggaaagggtagaaaaaagggtcataataaattagaaggtaaaagttcacctaatgttgaaggtactcattcttatataacaaatggaggtaatatagaagaaacaaaaagccaatcatattctgtaactgacaattatgttgaggaagaagctgcaagttgcccagaaggtgaccaaaattgcattgatcttataaaagacgaatttatcatagaaggtggtcgttttatccgtacatcaattaatgatgttccacaaatggaagctataactaacaaatatatgcctggatccatttatgaaaatccttcatctggtagttcacatattgaagataaaggacaattaaaagatttcactattgaaacagtcaaatatacatcagatggacttaatggatttgatcatgaagaaccagtgacagatcctaaattattacatggtgaacaacttatagaatttacgggaaaagtttatgaatctctacctcatcataatgatattgcgttgcatggtagtccaataccacgtcgacgtttttcaagaagctatccattaaatactacaactacattggaaggtacatctcaaaaaccatctgcagttgaaacaataatgtccctatttagaaatatttttgattctataaaaagttcttcaataactagaagaagcgttaattcagctcttgaatttagtgaatctacaactaggcctggaaattcattttctttgcctcaaatgacttgggaatttgaagctcctggtcaaggaacggtgatgagaatgttaggacagaaaaattctttcaaaacacttgcacaaacaaaacaggaagtttcttcatctagttctgaatcacgttcaagttccttcaacaataactcccaaataattccccatatattgaaaacgcaagttgatggaacatatgttgtgtcaggacataaagcaaatgttcccaaaggcattgaacattatataaagtatgtccccgtagctttagcagtttttggagttcttttcgtttttatattatttaacaaa

SEQ ID NO: 373 - DNA, 474 bp, Plasmodium falciparum
atgaatattcgaaagttcataccatctttagctttaatgcttatattcttcgcttttgcaaacctggtattatcagatgcaaatgacaaagcaaaaaagcccgctggaaaaggatccccttcaactttgcaaaccccaggaagttcttcaggtgcctctcttcatgctgttggacctaatcaaggtggactatctcaaggtctttctggaaaagattctgctgacaaaatgcctttagaaactcagctagctatagaagaaatcaagagcttatccaatatgttagataaaaaaacgacagttaacagaaacttaatcataagtactgctgtcacaaatatgatcatgttgatcatattatctggtatagttggatttaaagttaaaaaaacgaagaacgcagatgatgataaaggagataaggataaggacaaggataatacagatgaaggagacgaaggagatgattcttaa

SEQ ID NO: 374 - DNA, 2220 bp, Plasmodium falciparum
tatttttcaaatgttatagaaaatgaaataagtatatcctatttaatatttaaaattaataatctgcataattatcattgtttatataatatttttaaaaatatctatatgataagaaataaaggatgtatgcatattaataacacggatattattaatctatataattctatattgagggtactaaaggtattcaatggtcaaaagttgttactctttgattccacatatatgtttgatgatatgaatagaaacgaaagattaatgaatagggatgagcatgtgcaaacaaataatagtatttattataaaaacggtggttatgataaattaccagaagacaataattgtggtgatatccatggtgataatcattctaatgatatattttcgtataacgagagcagcttcttgaattatccatccaatttttctgatgaaaacagaagtaccttggaggagtatacaagaagatgttcaataaataaaataaatgaacataatttacctaaagaaaaaaatatatcaacttatactgataaaatggatgccaaaataaatgataaacaaaataatgacaaaatggatttagcgaatagtgagcagaattatttggaaggtgatttaacaagtgatatgtatgaatgtacagaagaaaaggttatagataaattaaatatggataaattaaatatggataaattaaatatggataaattaaatatggataaattaaatatggataaattaaatatggataaattaaatatggataaattaaatatagataaattaaatatagataaatcacatacagataaatcattcataaattctgaaagttttaatttcagtgaaaataaaataaaaagtggtgtgagcgaatttttattaccttcagcatcacaatatggaagagagaattataattatgataaagaatttctgagaataaatatttatgctgaaaagattccacttatacatatgagagatattatatttattaataatttaataaatatatttgtaaacaataataatttattttctaataatatgtataaagtctatggaaaggttctcatatttttaactacatattcaccatatgaatatgtgtacaaccaatattactcttccttttttgaaaagaaaaagaaaaagaattcttttaaaaaatattgtacgtcattttttgatatttatgatgataggatgatggttggtacgaaagacaagaagaagaataagaaaaagaagaagaagaaaaataaaaataaaaattataacaataataataataataataaaattcttgaggatgatgaatatgttgataatatatattataacaatacaaataatgaccatcagtcatatgaaaaatcaaatgaaagtagtttttctaacgatacagataatgaagaagaaaaaaaaacagacagtatattaaacgtcaaaaataataatgatgataattatacaataaaaaaaatgaaccctgaaaaaaagatagaaaataattgtcttgatgaatttaataatgccttaataacaaatggaaaggataatataatcggtttaaaagataatacaggagatgaagaaaagacaaatttaaataacatgagtgacaagaatttattaatacaaaatcaaataaatgaacatgaggaaaagaacatgaaagagtgggatgataataagaaaaagaattcaaaaacgatttgttcaattaaaaatattatagatcgaaataaaaaggaagaatatcctaataatattgatgatctttttgaaattaaaacagaagctaaatcttgtcatgaaataaaaagtagtgtatttcttaatattaaaagtaaaaaaaaattaaaaactaataaaataaataaaaaaaaaaaatattatttttataaattattccataaatttagaatgtcatataatcattttattaaatatacacaaaatgaaattttccatatatatgaaataatacatggaaattattcagatgtacaaaaagataaaatgttaataagaaaaataaatagtaatttagcagcatctattatttataaatatatttataataatatatatgaatatattaataactcaaaaattaatttaatatatcctaaatttattcttttaaaatatattgtcgataaatatcctcaaaagagatatttaaccctacactttttaaag

SEQ ID NO: 375 - DNA, 2967 bp, Plasmodium falciparum
ataagtaatcacaagagtataagtaatcacaagagtataagtaatcataagagtataagtaatcacaagggtaaaaataatcacaagagtaaagataatcacaagagtaaaaataatcacaaaagtaaagataatcacaaaagtaaagataatcacgatagtgataaaaatgaggaagacatagaaaatgatgaagatacattacatataattgatggcgaaacaaatacaaatttgtcatcagatgtaagcgaagacgattcctctaatacagatagcgaagacgattcctctaatacagatagcgaagactctggtaaagacaattttgatgagaataatttttctctaccatattttatatttgtcttaagagatgtaaataaggaagagttttccaaaatgaacttacaaaatgatagtttgtttaatgaggaagattcaaatatgaatggaaatgttaatggaaatatgaatggaaatgttaatggaaatatgaatggaaatgtcaatggaaatgttaatggaaatatgaatggaaatatgaatggaaatatgaatggaaatgttaatggaaatatgaatggaaatatgaatggaaatatgaatggaaatatgaatggaaatgttaatggaaatgttaatggaaatgttaatggaaatgttaatggaaatgttaatggaaatgttaatggaaatgttaatggaaatattaatgagaatatgaataatctttttaatgactgtatgtattataatcaacattctaacaacgaacatgacaataatgttaatggtaataataatattaatagtaacaataataataataatggtaacaattttcattatagttatgataattattcatatgattccttagctagacaatatttagattcactaataaacatgataaatgacgatgtaacacagaaaaaggttcaatgtatgttaaaattattaacaagaaaaaacatattcatgttaccatcattatatacaaacgataacgattatattataaatgaagaatatatgaaggaattaagtaaaataaaaaaagagttatatatccaagggaaaacaatagataatatgtataaaaataatggtacgtatatatataaatatataagtatgttattatatacaactaataatgatattttttatacaccaaaacaattacaaaaaaaaatagaaaattttgaatgtaaaatgttatataatgttcttatagataatttcttacttcatataagaaaaaaaattgaaaaaaaattacccatgaaacctaatatgtttttaacattaatcaatgatttaaagatagagtttattttaacttttgaaaaatttgctattggaaatataaaaattaaaaaaaaatataaaaaccaattatattctgatatggatgttataatattaaaagcttataaagaaaatatagcattcagttgttttagtttttataatattattgatcaaagaataaacactttacaaatttatgagaagattaataattttaagtatgaaaactttagtcagctacaaatcgatctagatcttattaatgacgagaaagtagataatcttatatataatgaaatcttaggtataaaaaaggaagaaatatttacacacttcatcaatgtttatcatgataatgaaaaagaaacaactgatctgttttataatacggacttagcggataacaagcaaaaaaaatcgtatgctctaccaaaagaaaaaaaaagcctaacacatgcaaatagtagaacacatgaaaataatgataataataaatataataataacaatagtaataataatgatacatctgatacattaagcgacacggataataataaaaagtatgaataccaaaaaagtaaaaaaatctcgtcgacatatttaggaatagacaaaaacaataataataataataacaataataataataataatcttaataattatggtaatccattgttatatggaaacagtatgaaaaaaagcaaaactaaatacgaagggaaatttgtaaaatatgaagataccataaatcaagataaagatactgatgatatttcctttaaagagttcgaacaaagtaatgagaagaaaagttcgaaaataaatacatataataataattcttatagaagaaaaagtacaaatgaaatgtatgtcaatgctgatgattcttatttttatcaaaccaaaacaaaattaccaagtaagagtaattatattaataataataataataataataataataataataataataattataataataataataatatcaacagatcaatgagctcatccaaaaaacaataccataaatttaaatctgatctaggtttaatatatgcaaggaaaaaaaaagtacacaaatataatcatgtacccaaaaaatattatagtgtagattattctaacgaaaataatgaatatatacataaaaattcggtactatatgaaaatgtgaatagttcagaattattcccagaagaaggtgtagatatatacacagatgatgataatatacaagatgaatacgatcaagaagtaaattacaacgccctacaacaaaataataaatatctatcatcaaatagtagattatatagtaaaaatgataaattaggaaatcattccaaatcgaatatctctagaaacataagtaattctgatatggaaatggtaaatttgaaagaaaacgatgatgatgaagaagtagaagaaaatgatgaagatgatgatgatgataataataataaaattgcttttattaaaaaaaaagtctctagtaatttatctaatataaaagataaattaacctttcatgaaaaaaattattccgaaagtaaaaaatcgagtcaaaccatctcaaggaagaaaacaaggatgagttgtctaccaaaaaaaaaaagttcaaaatga

SEQ ID NO: 376 - DNA, 300 bp, Plasmodium falciparum
atgaagttacgtattctaaaaaaacactattacgtggtctttatattgttgtatttatatgacattagttgttttaaatgtatacgtttgaataatcgtagtatttataagaataaatacaagaataatgtccatataggaactaatgagaatataagaagtatagaaaaatattccaatgttttatgtaatagtatattatgtaaaaatgataaaattagttcatttataaatcaaagaaaaaatgtagatgatgatgatgaaagtgaaaatgatgatatgtatgaatctactacagct

SEQ ID NO: 377 - DNA, 1305 bp, Plasmodium falciparum
aaaaaatccaaatctactattgatctcttgcgtgttattgatatacccaaaggagagtatggaatacctacatcgaaatcaaaaaataggtacataccgtatgccagtgatcgatataaaggaaaaacatacatttatatggagggggatgaatcggatgactacacatatattggagatatatcgtcatctgatattacttcttctgaaagcgagtatgaagatattgatataaataatatatatccatataaatcacccaaatacaaaactttgattgacgtggtactagaaccatcaaaaagagatacatttaatacacaaagtgatataccaagtgacacatctaccaataaatttacagataatgaatggaatcaattgaaacaggattttatctcaaatattttacaaagtacacaaatggatttacctaatgaaaatatcattgatgattttatggataagggtatacaacctaataatcctgttttagacgttaatatggcagaaaaaccttttattacatctattcatgatagagatttacataatggtgaagaggttacttataatattaattttgatgtttccaaaaatattaatgagattactaatactacggatgattcaaaatatgtttcaaacaatatatatagtggaattgatttaattaatgattcattaaacagcgatcaacatgttgatatttatgatgaattgttgaaacgaaaagaaaacgaaatatttggaacaaatcatacaaaacatacaacaacaaatagtattgcaaaacaaacacatactgatcctatactcaaccaactagatttgttccataaatggttagatagacatagaaatatgtgcgaacagtggaataaaaataaaaaagaagaattgttagataaattgaaagaagaatggaataaaaaaaataacaataatagtgatctcacacacactagtagtaacataccaagtggtgaaaatagtattaagaatgtgttgaatactgatgtttctatacaaatagatatggatgatcctaaacctataaacgaatttacatatatggataatataattgataatttggaaaaaaatagtgaaccctactatgatattgatgaagatgatataatctattttgatatagatgatgaaaaaacacctatgtatcataataatatggataataataaatctaatgtacctactaaagtacaaattgaaatgaatgtcattaataagcaggagttattccaagaggaattccctatatcggatatatggaatatataa

SEQ ID NO: 378 - DNA, 2106 bp, Plasmodium falciparum
gatatctatacgaattgtgaatcacccacctattcatacagttcaataaagaataataatgacagatatgtaagaattttaagtgaaactgaaccaccgatgagtttagaggaaataatgagaacatttgatgaagatcatctatattctataagaaactatattgaatgtttaagaaacgctccatatatcgatgatcctttgtggggttcggttgttacagataaacgtaataattgtcttcagcatattaaattattggaaatgcaagaatccgaaagaagaaaacaacaagaagaggagaatgctaaggatattgaagaaataagaaagaaagaaaaagaataccttatgaaagaattagaagaaatggatgaatccgatgtagaaaaggcatttagagaattacaatttattaagttaagagatagaactagacctagaaaacatgtgaatgtaatgggagaatctaaggaaacagatgaatctaaggaaacagatgaatctaaggaaactggtgaatctaaggaaactggtgaatctaaggaaactggtgaatctaaggaaactggtgaatctaaggaaactggtgaatctaaggaaactggtgaatctaaggaaactggtgaatctaaggaaactggtgaatctaaggaaactggtgaatctaaggaaactggtgaatctaaggaaactggtgaatctaaggaaactggtgaatctaaggaaactggtgaatctaaggaaactggtgaatctaaggaaacaagaatatatgaggaaacaaaatataacaaaataacgagtgaatttagagaaacagaaaacgtgaagataacagaggaatctaaggatagagaaggtaacaaagtatcaggtccatatgaaaactcagaaaattccaatgtaacaagtgaatctgaagagaccaaaaaattagccgaaaaagaggagaatgagggagaaaaattaggagaaaatgttaatgatggggcatcagaaaattcagaagatcccaaaaaattaacagaacaagaagaaaatggtacaaaggaaagttctgaagaaacaaaagatgataaaccggaagaaaatgagaaaaaggcagataataaaaaaaaaagtaaaaaaaagaaaaaatcattttttcaaatgttaggatgtaatttcctatgtaataaaaatattgaaactgatgatgaagaagaaacgttggtagtaaaagatgatgctaaaaagaaacataaatttttaagagaagctaatactgaaaaaaatgataatgaaaagaaagataaattattaggagaaggagataaagaagatgttaaagaaaagaatgatgaacagaaagataaagtattaggagaaggagataaagaagatgttaaagaaaagaatgatgaacagaaagataaagtattaggagaaggagataaagaagatgttaaagaaaagaatgatggaaagaaagataaagtgataggatcagaaaaaacacaaaaggaaattaaagaaaaagtagaaaaaagagttaaaaaaaagtgtaaaaaaaaagtaaaaaaaggaattaaagaaaatgatactgaaggtaacgataaagtgaaaggaccagaaataataattgaagaagtaaaagaagaaattaaaaaacaagtagaagatggaattaaagaaaatgatactgaaggtaacgataaagtgaaagggccagaaataataactgaagaagtaaaagaagaaattaaaaaacaagtagaagaaggaattaaagaaaatgatactgaaggtaacgataaagtgaaagggccagaaataataactgaagaagtaaaagaagaaattaaaaaacaagtagaagaaggaattaaagaaaatgatactgaaagtaaggataaattgataggacaagaaataataactgaagaagtaaaagaaggaattaaagaaaatgatactgaaaataaagataaagtgataggacaagaaataataactgaagaagtaaaagaaggaattaaagaaaatgatactgaaaataaagataaagtgataggacaagaaataataactgaagaagtaaaaaaagaaattgaaaaacaagaa

SEQ ID NO: 379 - DNA, 402 bp, Plasmodium falciparum
gattactatgctgtattaggtcttactaaagattgtacacaagatgatataaaaaaagcatatagaaaactggctatgaaatggcatcctgataagcacctaaatgacgaagataaagttgaagcagaaaggaaatttaaattgattggtgaagcatatgaagtgttatcagatgaagagaaaagaaaaaattacgatttatttggacaatcaggattaggaggaactacaactaacgatgaagcatattatacatattcaaatatagatcctaatgaattgttcagtaggtttttttctcatgatgcaagttctttcttttcgcaaggttttgatgactttccatcttttcaaggtttcgcaagtatgaattcaagaagacctagatcaagcagatcaaat

SEQ ID NO: 380 - DNA, 567 bp, Plasmodium falciparum
aatattttttctcgatcatttggtagagcagcttcatttgaagttcccttgcaagttacactggaagaattatataccggttgtagaaaaaaattaaaggtaacaagaaaaaggtttgtgggtcttaatagttatgaagataatacatttataactgttgatgtaaaacctggatggagtgaaggaacgaaaattaattttcatggtgagggagaacaatcatctcctaatgaacaacccggagatttagtttttattataaaaacaaaaccacatgatagatttataagagaagggaataatttaatatataagtgttatttaccattagataaagctttaactggttttcaatttagtataaaatctttggataatagagatataaatgtaagagtagatgatataattaatccaaatagtaaaaagataataactaatgaaggtatgccgtattcaaaaagtccatcggttaaaggtgatcttttcattgaatttgatattgtctttcctaaaaaattaagtcctgaacaaaaaagaacattaaaggaaaccttggaaaatacg

SEQ ID NO: 381 - DNA, 1158 bp, Plasmodium falciparum
aggtcatatcccaaatctggccataagggacatacgaaattaaatcaaccagtagttagaacattagcagattttaatgacatgtttgcaaaccaaaaaaatacatttaattttctaaaacatataaatcattataaaaatgaacaagatacaaataatacacacacgccaaatcatgatgaatattctcataatttgccaaaaaatcacgaagagtcaaatgcaaatatgaacaatcataattctttcaatgacaaatctgttaataaaaaagaagctttcgatcaatttttacaaacgttattaaacaattatgaaataatgcataaagaagatgaaagtaaagaatcaaatcaacataactataaagaaggtccctcatatgaagataaaaaaaatatgtacaaagaaatattgaaaggatattataatgtattttttgaaaattatgcaaacgacacagaatcaaatgtacataataaacctgaggaagttcataaacatgaggaaattcataaacataggaaacttcataaacatgaagaagttcataaacctgaggaatttcataaacctgaggaatttcataaacatgagaaagttcataaacatgaagaagttcataaacctgaggaagttcataaacatgaggaaaatcataaacatgaggaaaatcataaacctcaaatggtaggtcaagcacctccagaaaaagagatacgccaagaatcaagaactctaatacttggttcatttccccaagcaggtgaaatattaagagaggatttatggaacaaagaggataacaaatttagttacgcacttgaccctaatgattatgcatctatagaagataaacttttaggatctatatttggatactttaaaaaaaatcatgacaatttggttaaacatttgttacaacaaattaatacttacaaacataaatatatggaacttaaagaacaatatattaatgaagttatgaaacttaaaaaaatatataacaaaagcatcatggtcatatttatagcatcttgtatttcaatattaggacctgtaatgttacacatgcatcaaaataatccagaagaattttttgcgaccatattaagtttttctatatcattaggtcttcataatttattactaacttaa

SEQ ID NO: 382 - DNA, 1203 bp, Plasmodium falciparum
atgattagaaaatttttgatttcgttatttttaatatttttatgtttgaacaatgttgtaattggaaataagtgtaagaaagcattgatagatattgatacaaaggatttgtctttgtctagtatattacgtgcacataaacccgataatacaacattaggttcatgggtttattttttctttaatcatttttcaaatgtggatgaagcaatagaatatttaaagggattaaatataaatgtattagatattgaagatcatgcttgttttgcaagagcttttagtgtatatttgcttcatttttatgcaaaagatttaaaaatgatgattagaaatgaagaacatgaatcatttttcaaaaataaattaagtgaaattaataatataatatctggtgatttcctttcaacattaaaacatgaatatttttttgataagttaccatctattatagttaaagaaaaagatgcatcccatatagtaaaaaggactgattttttacaagatatattagaaaaagcagatttaaataaccatgcaatttataaaaacgatcctacaaaagtatttatttttaatgaaataaatttttttagaacattccaattagaaggtaaaccacatatacctgatgatcaactttcttttatgcgtgattatgctttattaatttatcttggtactaaggaaaattattataattctgatataacagaatatgcacaaggaaattataatatttcgaaaaatagaacaagattaggattaaaaaaacgtagtaaaacattttctttagatgatccccaaaaaaattccaatatatttgctttttgtgaaaaaaatggaaaagaagaattttttggtacacctgatgatttaatttcatcatttttttctgatatgaaagctaaaatggttaaagggcataagagatttttgatggaatttgattatgctgttaaaaatagaacttatgctttacctaaagttaagggatttcgatttttaaaacaactttttcaaagaaaaaatttaaaaaatttcgtaggaatgtatataaaccttctgtctactgaaattgatttcttagcagaagattttgtagaaatgttcgatactactatgaattgttatggacgccaacatgccgctcgtgcagcagatcattatatggatatgaaactatcgaacatattcaaataa

SEQ ID NO: 383 - DNA, 1644 bp, Plasmodium falciparum
atgccaaatgtatatttacctcaaattttatggcatagtaaagataacaaaagaagtgatcgaatttattctttagatattcaaccatatccaaattattatagtgttaaaaaattaaataggaaatatgaattgtttatcaaatatttaaaagaaaaaggaaaaatagaatgtaataaattcgacactttagaagaaaaacaaaaaattataaatgattcaacattgccctcaaataataattataataatagtagtaataataataataataataataaatatgaaacattaaaattagataaagaactgaatcaaggaaatgaggataacattataaagacggtaattgggaataacacggaagttagtaataataacttattagatgatacaaacaataaattaaacgaaataaaaacaaatacatctacggaagatcaccaagaacacaatttagtaaataaaaaaaacgaaacgaatagttcatctaatgacaatatttcacataataaaacaccaatgcaatcaaataaattacttacatcattacaagatgataaaacaaaaaaaaaacctatcaaatttaatatagctacatgtggtgctgacgaattcgtacatttgtggagaatatttataaaagatgatatttcaattaaatgcttaggtagatttataggtcatagtggtgaaataaattgtgttcgttttaacaaaaatggtagatatatagcaagtgggggagaagataaatttttatatatatgggaaaaaagtaaaaaaccaaaaaatataccattaggttatgatataagctttttagattataaagaatggtggaatgtcgtagggtctttcagatgtagtggtgtaataaatagtattatttggtcaaacaatgataccttatatgtagcaaatgaagataataatatcaatattattgattttgtaaaaaatacaaactgtaaagtacaagtcttagaaggacattcaggtattattcaaggaatttcatttgacaataattatgaatatttagcatctcttagtgctgatcaaacattaaaaatatggaaaaagaaaaatgatggaaaatcatggaaattagaaaactccataaaaaatataagaagagatgaattggataaacttaataatgcatgcacgacatgtactgaatatgattttcctgataaaaataatacggacaaatacgaatccaatactttaaaacaagaaaataaaaaattaataaattatgatttattggaacaagaagcatataaaaaaaaaacaaaaaacaaaaaagaaaaagcagatgaagacgaagaagaagcaaataataacgaagatgtagaagaacaacaaacggatgtaggagaagaacatatagaaggacatctcaataataatatagtgcttaattcaaatattaacaaaatgaacaactccaataatctcaaaatgaataactccaatacaatcaaaatgaacaattcttttaatcaagaaaataatgttaaaccataccaacaaatacataccaagtttatgtcaaaaaaacatctagaagatggagaagaagaacaagaagaagaagaggaagaaaagaaattcaaaagaagccttttttcaagt

SEQ ID NO: 384 - DNA, 1641 bp, Plasmodium falciparum
gaacaagaagaagaagaggaagaaaagaaattcaaaagaagccttttttcaagtgaggaaatgctaccttcctttttcagacgtattgatttttctccaaatggggaatttttaataacacctagtggtattcaatttgaacaagtggaaaaagttaacgagaaaaataataaaaccgatgaaaatgctaaaccaaattatgaaattaaagcttatagctgcttttatatatatcataaaaacttatttttaaaatataatattcctttttttaccatattttcacaaacaagccatttcttagtagccaaatttaattataatacattcaaattaagaacagaacaaaatattcttaaaagatgttatgaacattttcttaataacttatctgatgtaaatgatgaagatatatcaaattcaaataaaaaaagaaaaatatatgatgataatttaaaattaaatgagttaatgtataatgaaaaactaatcaaattgaattatgaaaaaactctattatataatcatattgatatacctgatgatgtaagtcaaattgttagtagtaccatatcagaaagtgatgttgaatttaatgaagataaagtatccttgaaggaattatccgccgaaaattgcttgatgaaaaatacggaaaggaatgaggatggaaatgatgaagacaatacagaagagaatgttgaagaaaaaaaagatgatataaaggaagaaaaacaggatgatttaaaggaagaaaaaaaggatgattcaaaagatgattcaaaagatgattcaaaagatgattcaaaagataattcaaaagatgattcaaaaggtgattcaaaagatgattcaaaaggtgattcaaaagatgattcaaaagatgattcaaaagatgattcaaaagatgattcaaaagataattcaaaagatgattcaaaagatgattcaaaaggtgattcaaaaaatgattcaaaagatgattcaaaaaatgattcaaaggatgacacaaaggaagaatcaaaaaaagaaaacgaattagatataaataacaaattgaatgcagatgaagaagaagggaaaaatgatatcatggacaaatataatgataacaatgataatgttgaaatattaaatgaacaagatgcttcaagtgaacttaaagataaaaaggaggaaagatttatatatacattaggaacgtttgatggaagtgtatatttttatgatagtgagattcttgatatacccattagtatagttaagaatatacatttatgtcctataacagatatatcttggaataatttaggtaacgtttgtgcatgttcaagttcagatgggtatgttagcttttatcactttaataataatgaattaggaaatattaaatcttataaaaattactatttggataaaaaatgcaatgatttaacattcgatcaaaattattttaaaaacactttttatgatgaagtagagtttttaaataaagatgaatctaatgattatacgtctagcgaggatgaatttgatgatcataatttaattcctcctaaggaagaaacaaaagtgaaaagaattaatttaatagttggtaatgcagcaaattttgtcttatcgcaaaatactaagaaatga

SEQ ID NO: 385 - DNA, 1596 bp, Plasmodium falciparum
atgagtacgataattataaggttaagatgtgacataggtctttatcgtatagaaatagaaaataataagcaattaattgatttaaaaaagaaaattgaagaattattatctgtaccattagaaaaacaagaattatatttattagattctcctcaaatattattaaaagataactatgtaaaattaagagaatgcaaaatacaaaatggtagtatgattcaactaaaaagtgatataaaaccaagtactaaaaaaaaagaagagaatgaaaaaaaaaataaagagaatataaaaaatactgatgaaaataacaaagaaacatatgataaagacgtacataaaaatcaaatggattcattgtgtattcaaaaaaaagaaagtattgtaaataataatatgaacaaaatgtatgaccataaaaatacatataataatagtaataatagtaacattaataaaaatgacaattataataaaagtgaaaacagtaataacaataatgataataaaaaaggagaatctcaaccaaattttaaatccttcgattattttttaaaacaaagaggttataataccaccgatttacctcttaatttagaatacaaatctgtttatttatgcaaaggtcgagttaataaaataccgttaagcattacattgaaacatcaagaatatagacatgtggatcatctagaattaatgaatgtagaagaagttagaaattttgttaattattggtatacttataataatatgttagaacaaagaattggatggatgtatggatattatagagaagataatcattacaatttaggtattcgagctgtttgtgaatgtatatatgaacctccacaattttgtgaagataataaaatacatttattagaagatgattttctacctactgtagatttaatcgcagaaagattaggtttagaaagaataggatggatatttacacatttacctagacaagaatatcttacatctgatgaagtagtaaatatagcaaaaatgcaattaacgaatattaaaaaaaatatgcattatactaattatcctatatctaatttcattacgtgtaccatttcaccggaccctttattaagtaatgaacctgttactaatgcatttatggtttcggatttaggtatggccttaatgagagataatctaatagaagaaaatcaaatagatccttcacatatccaattaagaaatccaaataaaaatgaactattaccacaaattctagaaagtggaaaagaaacaaacaaatttgacacagattggtttattgtacgtgttaatgaatcagctccgaaggttgtaagatccatttttaaaaatttccattttccaagagaaaatagacaacattcacaatcagcttttcatgttaaagaatattttaggagtaataaattagatagaggaacaaaaggaatccatcaatgttccgattttcatcttatcttatttgtagccaaagttctagatatagaaacagctctagccttatgtgacgcaactttaaataaaaaagaaattgatccaattatagaagaaatgttaacatcagtaaagatatag

SEQ ID NO: 386 - DNA, 2316 bp, Plasmodium falciparum
tcccattttatagtaaataataataatgatgatcaagataaatacaatcttgtgaataaaataaatatggaaaatcttaacaaaatgaacaaagaaaatataccgaaggatgaagataacatgatgtatttaaaacaaagtgatagtaaaaacagctttgataattattgggatgtagacgatattaataagaagggtcctttcccgtcatcaaaattgagtgtctttttaaatgaaaatgggaataatgaacaagttcataatatgcaacttgaacttaataatatacaacattatgataacaaaggagatgttaaacaacgtaataattatgttatggaagaaaattatttagtagaaaattttattaacaaaaaaagcaacgatctaaaaagtgttccatatgatgataatcttactaatctaaatacaaatgaaaataatgtgtataataatgtaaaagacgaaatagaagtttcaataaataaaaatacaaataaaaatataattaatttatacgaaaataattttaaaagtatatcacagtgtcctcttgaagaaaaaaggataaatcacgtgtttaaaaaatttttaaataatgaagatttagatattcatataaatagaaatatggataatgaagaggaaagtcgaagaattaacgaaattaaagaaataattatgaagtatgcaaataatagaggttatggtaaagatggagatttgacatctgagcatgtgattaaaaaaaatgataataaaaatggtgataacaaaagtgatgatgataataaaaatggtgatgataataaaaatggtgatgataataaaaatggtgatgataataaaaatggtgatgataataaaaatggtgatgataacaaaagtggtgatgataacaaaagtgatgatgataataaaaatggtgatgataataaaaatggtgatgataacaaaagtgatgatgataacaaaagtgatgatggcaatttttttgttgagaatattacaccagaagaaagaaataaaatagatgaatttttaaaaaaacataattatctatataaaatagaaattcctacaaatttatatagagatgaagggaaattaaaagtgaatcctacgggtgatataaatgtacaaaagggtggtgattctataaatagcccaggtaataatagaaacaggaatgatacgaataatagtggtaataataataatataaatgatggtagtaataatagtaatcgtaataatagtaatcgtaataatagtcgtggtaataataataataataataatgacgacgacgatgatgatgatgataataataataataataatagaaataataacaactttagtagtagtaataatacaaatgaattagtttcaaaagtaaaaagacgaattattgattgtaggaataatagattaaattggggttcaacacaagttattatagatattgatgatactataagatctagtggaggatataaattttttaattataatttaggaggtgtagatgcacaatatcaaagaggagaaacttatccaggatcttttcaatttatttttgaattagctatgaataagttagctgcagaagctaaaccattattattatctgtgttaacagctcgaattcctcaagtacccataacagaagattcatatttaaataagaaatttaatgaagtagctgaaagaagaggtataaaacattggggtattgattgtgaaaataaaattttatattcaactttgaaagaatgggtttggaatgaaacaaggggtgaaaagaaattttttaattttaaacaattacataaatatgtaatacaacaaaattcattagtaagatatatatggataggtgatacaggtgatatggatagacaagccggggaattaatgattaaaacttttccacaaagaattaaagctgtttttcttcatcatgtcaaaggcaaagatgataatacactattaccaagtgattattttataaaatcagtacccatctttttttttcgtacatatatcggagcagcaaccaaagctcatgcatataatctaatcgataaaaaaggattaacaagagtattagtacaagccgttctagatcttgaaaaaagtaaagtaccagcagattcatcaaaatgggaagatctaataaaagatattattttaagtgatgcattagatgaactagataaatataatgctgaaacggttaatagaactaaaagaattatagcacaaaaaatgaaagaaatatcggaaaggaaattacattttataagttaa

SEQ ID NO: 387 - DNA, 2880 bp, Plasmodium falciparum
atgtacgatataaataagtcaatatgtgctgagataaaaagtgcggaacttgatgtattaaacagtggggagttgagaagaatatctatgggtaaatacgaaaatgagaaatatgaatatgaaaaaactcataaaagtggagttgttacaaaaatgtattatgacccgaaatatggtactattgatcataatcaaatatgttcagtatgttttgaaaggcacgagaattgtacaggtcatattggtcatattgaatttgttcttccgttatttaatccattattttataaagaattacaagaattattaaatttgatttgttatcattgttataatttttgttgttctgaggatgtcatttttttattaaaacatatttttcaattgaaatctttgaatcaaattgaaagcacgaataaaataaaatataaaaaaaattgtgattatgaatatataattgatcaagtggaaaaattatataaaaaaatatgtaaagattcaaatatttctttagacgacattgttgaagcaatatatgatgattatgaaaatgttcatgaggataaggatggaaattttgatgaatcagttgatcttttggattctctggaaaagataaaagatgagccggatgaaaaaaataaaaataataataataaaaataataataacaataacaataataataataataattataacaatgatgtagatatagatgttgataataataacaataatgtagatataaatgttgacaataataataattattttaatagcgatcttgtcgacttagctcctaatgaagaaatttatgaggaagaaacggacgcaggaagaagtgatgataataacaaagaaaacaaacctgattataacaaattaaaagaaagaattaagaaatataaatttgatgcaaataaattagcatttcaatcaaattataattatgaagaatatttaattttaagtaaaactataaaacttcatatgaaaaaaagtagcaaatgctgtttttgtaaatttcaaaggaatataagtgcaaaggtatcacaaagaagagataccataaatttcataggagtacacacaaacaaccctttttttaaaaagtatatgccaaagaaaaaacaaaaaaaaaatgaaaaagatgatcaagaagatgtagatgacttggaaaatatgaataatattgatgatataaattataatgatgatgtagacaacatgcagcatatgaatgatgatgaaagtcaattgaatagtattcaatcgaggaatgaaaataataaactaatgataaaaagagaaagtaaaaaaattgaatacaacaataatgttaatgatgagtcgataaaaatagaagaggataataatgaagatgatgataaacaaatggatagggagagtagttatccacataataataataataataataatgataataatgagaattataataaactaagtggtggatatgaaaattcttttaacgaaatatcaacagataatataagaaatgataaaaataaaaattctacctttgcagatatggtcaatcattataatagaacacaagctcctaaagagaaatgtaccatacgtttattcagttttcaagttatagatatattaaaaaaaatttttgaaaataataataaagatattataaatttattatatccttttaccaaaagagatggttataagaaattttttttatatgatatgggtgttagtggaaatagattccgaagtcaatctaaaggtatacatgttcgaacaaaaataacaaatacattatgtcgatttaataattttattaagttatgtataaatgcaaagaaaaaggttgattttgattatttattagaacataataagaaggatttaaaattatataaagatatgttttctgttttttctttaaaaatgaaatataaatttaataataatataatggatgatgatacagatataacaaagatggattttttaaaatattatactttagtatataataataaaagtgcatatataaatatattatttagtactttacaattaggtgttaatacattttatgattccactttaacagaaaaagttaataataaacatttaaaaaatattagtataaggcaaatattagataaaaaagaaggaattctaagaaaaaatattatggggaaaagagtaaataattgtgcaagaacagttatatctccagatacatttattgaaacaaatcaaataggaatgcctatagaatttgcaaaggtgttaactatagatgaatatataacacaaaataattttacttatataaaaaagttaatagaaaatggaccaaatatatatccaggtgcacttagctatagagattcaaatggtagagtatttaaactatcacataaatatgaagatagattaaaagttattgaaaaaatagaaaaattgaatttccaaaccgaaaattcttatatacttcatagacatgcacgtgatggagatgtagtaataatgaatagacaacctacattacataaattttctattatggcccattatttgaaaatatttgaaaaagaaaaagtttttagattaaattatgttaattgtagttcatataatgcagattttgatggagatgaaatgaatttacatttgttacaaacaccattagctagagctgaagcaacacatttaatgaattgtgattttctatttacaagttttaaagatggttcaccacttagaggtttagctcaagattttattcttggtggtttacatttaacatcattagaaactttcttaaattatgatgaatattgcaatttattgcaatgttcattgaactctttgatatct

SEQ ID NO: 388 - DNA, 2874 bp, Plasmodium falciparum
atgtcgggaagagaaggtttaatagatactgcagtgaaaacagcaaaatctggttatatacaaagatgtttaattaaatgtatggaatcggttatattacattatgacggtacggttagaaatgaagataattcaattattcaatttttatatggtgaagatggtattgatccatctaaaacagcttatttagatttatcaaaagatttattacacaattatcatctttcatttagtaaatatttaaataataatatgcatagtaaaatattaaataatcaagaattatttttaaaacatgaaaaagataatgatacaaaagataatgaagaaccattaattagtaaatataatccatatacatatattggtagtgtttcagacaaattcaataataaattaaataatactcttttatggaatgatttaaatttccctgaatatgaaaatgtacccatgaattttgatactttatcatcatctcttttaaaatcaaaatattataattctttatgtaatcctggggaatctataggtatattagtagctcaatcatttggtgaacccgctacacagatgacattgaatacgtttcatttagctggtacagaaaacgttactatgggtattccaagattaaaagaaatatttttaacatcaaaattgacatctaaacctatgatatatgtacctataaaattacaagtagataatttaaaaaatgatgcaaataaaatgaaaaattatattacaagtattgcagataaaattttaagtagttataaaagtatatttttaacagatgttatatatggtattggtgtcgataggaaaataatattaaaagaaaatcagaacgaacaaaaacatactattaatttatcagatattataaatatgaatgatgaagaactaagtggagatacccagctagccaaaataaataatgttttaaaaaattgtaatattaattttgatatgaaaaaagaatggaattatgaaattataattcaatttgaaaatttatatcatttttgtaatattaataagcatttaaccatatcatttatactttacaaagtagtaaatgcattattaaattcggtgttaaataaagttcatgaaacttttgtatttcataatttgataaatatgaattcattaaatcatgaatattatgatgaattatatgatttcataagtaaaaaaatgtcagaagaatttaattttaatatggataaatatgaatataaagatgatgaacatcaaattaatgcaaagttaaaattcatggaaaaagaaaatgaacgttatgattctaaaagaggaacaaataataatatatcaggtgaatatcaaaatgcttctcatactatagctagccatatggaagatgactctccaatgaaatcatataatgatatttcaaataaggaaaatatgtctccttatgacgatggaaaaggaaaggatggcgatcgtgatcaagatgatatgtctgacattgaactcaaggataattctgaaaaaaattccaacagtgatcaagcttcgaaaaatgctgatagtgacacggacgaagaggaagaagatgatgaattaaaatcagagaaggaaaaagaagaggatgaaaaagaatatgacgaggagggagaaagtgacacgaacagtaaaattgatagtgatcataaaagtgatagtgataataaaagtgatagtgataataaaagtgatagtgatcacaaaagtgatagtgatcacaaaagtgatagtgatcacaaaagtgatagtgatcacaaaagtgatagtgataataaaaatgatagtgataataaaaatgatagtgatatagatagtgatagtgaatcagagatggtgagttcaaataaaaaagaaattataaatataaataataaagataattactatactaatagaaattctagtaatgaatccaaattatcagaatgttccaatactaaaggtagtactgtaaattatttttcatccgaaacaagtgctacacatcatatattagtagatgaagaagaatcaggtatttttcctaatttgaaaaataaaaaattaaataatatgaatgataataaaaatatgtcttcaactaccgtttcatcttcattatcatcatcatcattatcaacaccattaaataaaaaaaatattgaagatgatgaacatataaataatattcattttatagaaaaaaataaatataatgaagaaatggataataaagaagaatttattacaaaatcatttaccagattatcttatgattataaaaataatattaatttaatatcttcagatgatgatcaagaaaatattgaagaaaatgaagaaggacaaaaaatgaaaaaaagtgaacaaagatatgttaaaaatattattgataaaatcaaaagtagcctactttgttttattaaaaatatacatttctcacctgtaacatggatcttaaaattaaatattggatgggatatcaactttttcccatatcctatcgattttttaaatcatatcaaatcagaaattaataaagaagttttattcaaagttaaagatctaaataatccaaaaattttaaagggtaaagatattacacatagtggagctgaatatgaattacaaattgaaggaaaaaatatttataaattatataatattaaagataaatatattgataaaacaaaattatattgtaatgatatttatgctattgttaaaacatatggtatcgaagcaggaagattatgtattaccaaggaattaaaaaaagttttcgatgcttatggtatacaaatcgattttaggcatttgtcatttataagtgatttcatgacccatacaggt

SEQ ID NO: 389 - DNA, 2796 bp, Plasmodium falciparum
agtgaaagaataaaatatttatatacatatatgaatgataaaattaataatatgaataatattaattataaatcatatttccaattatgtaattcaaatgaaattccaaatatacaatttataaatgttatagatatacaaaaagaagaaattattataaatggtataacacgtattaataattatattaattatttaaacgtttggatacaaaatgttaatgattgtataaattatgtaacaaattgtggatataattttaattatttatctaacctaaataaagtaaaaataaatattaatgatttaaataataatattgttgatgttaataatagtatacataatattgaaaaggaggatatatttaaatcattaagttatccaaaggatcattccacaacttttgaaggtattcataacaatatgtcccataaagaaacaagttcaattcaaaacaaaggcaaagaaaaatctaataacaacatcaaaagcgacgacaacaataataataatgataattattgtgttggagattatttagaatttttggaatatgattttattgacaatccagatgaattgaaaagaattccttatagatattctagtgattttaaatcattccatatgtttgaatattttagaaaaaataataataacgttattgtttctttacaaagaatctttatttgtatgcagttatattcattagttctttgtgccaaaaaaaaaaaagatcattttgaaaaatatacatcagatgttaatttaaatgaactctattataatgaaaaggataatttccatgataatatgaataaatttaaaggaaagaacaataaatataataaaaaacaagaatattataatcaaaacaattatgattgtggtgtaaaaaattcttattcatcctccttgtcaacagctgttgaaacattaacagctaatggaattaaagaagctaaagatgatgatttaaacaaatcatctttaaataaaaagaaatgtcatgataaagataataacgatcaacctcattatgttagtaccaatagttcaaatagtgatgatgatgatgatgatggtgataataataataataagaatgataatatggatgatgattcgtattatgaaaggaatagtatttttggagataataatgatgataaggatgatgatgatgatgatagttatttagataatttttctgattctgatgggaaaaaaaacgacccttcatataaatatgacatagaaaataatgaagaaatgaaattttataaagatttagaattacgtaaaaaaaattgtttatattattatagaaatgccctcttttataatggttcatctatgataccttgtgaagaaaataaacattttactatccctttaaaaggtatagataataatggtgcaaaccctgaaaattttgatgatggtacagaaaatatgtgttcctttttaaatatgtttagcaaaaatgataattatttgaatttatttaaaccattaattccaaatattaaaattttattatttagtttaaataaaattttatttaataaacatagatgtaatgaacccattagaaaaatacatgaagagctgtttaaaagaatcgtttgtgatgtagcaagggataaaattaaattgaatagaaaaattaaaaaactgaagaaacagaataataaaggtgatattattaatgatttaattaatgatttaaaggaattacgtttttttgaaaaaatatgttatgagttgtttaaattaaaaagtaaaaattatagtgatgatgaagatagtaataataggatggaagaaagtgagtatagtgaaaattctaatgatttaagttatgatgaatttgattctaaaatatcaaaatatccaacaaaagtaggaaatgaagggaaaaaatcaaaagataataataataataataataataatatgatgggtgatgatgataataaagtgaataaaaatgaagaaggtaacgaacaaaatgaaagtgcacaaattaaggaaggtaaggaaaagaaattaagggattttattcagaaggaagatatacgaaatgaagataatgaatcttatgaatattacaatgatcaaggtaccgagaatttagatgatatgaattcagatgaatatatgaataataataataataataataataataataataataatataaaacgtttagatgattcatataataaattattgaaaaataaaaatattaattcattaatttataatttagtaagtaaattaaaaatggatttttataaaaattatattatttgtgataaggatatttttaaaactattggaaggttatgttttagtgaaataccatatgtattatttttatatatggattgttataagagtttaggaagaggtgatttggttgatatacctttatatttagatgtatttgaagaaaatgaagaaatggaagatgatagtaaaggtgaaaagaatttagtatattctataagaagaaataatatgagaaataaaggagatggatcatctaaggaaaagattacttatcatttatatgctctagttatatcacaaaataaaaatccaaataataatttatttatacctagttacaataaagtgaatgatatggaatttaatataggaaatgattgtaatttgaattcttcatcttatttaattttaaaaccacaaataaatggaccatggtatcaaatatataaaaatagaataacacaattaaaacaagctaccgattttaatgaa

SEQ ID NO: 390 - DNA, 708 bp, Plasmodium falciparum
gatgttgcgaaggcttgtgctgagggcgaaagtgttaatgtgctggacattttgggaggagataatacgaatgttggcaaattgaatagcaataaatattatgacaacttcatttatggtttgaataaaaatgatgatttttacaacgctgataaatatgaagagttaaggaagaattataattataattataattatgaggatatagatatggatatagaaatgcaaatgaaaaattcttattgttatccaaatgagaatgtagaaatattaagataccatttacataagcttttatacaatttagtgatacatgtgtgtaaaaagcagaatacattatttttaaaatataaggctaatggtgtgatattaagtgagtatgagatgaataagcaattatgtggtcctgtgtattattctagtgatttgacgtatgaagattttattacatcaaggaaaataaatttttttgaaaaacagcagataaaaaatagtgtatatcttttatcccaacatggaatatatggaattaaatttatacacttaacaaatgaatggtttaaattgtataaatgtgagttacgtcctctcatgaaaatatgtcattatccaaaaattggtcagatgatttgtaatatgcctaatgtatatgtagtgggagatggatttgatatgaaatatatacccaatacggaaatggataatgaa

SEQ ID NO: 391 - DNA, 339 bp, Plasmodium falciparum
agtgtgtttacaaacattgcctttataatttggatgtcctttttacttcttatgaatacttgtattacctttttttcctcagaaatatttttagtaggttggatcatcgacttactcaaacagtatctaagtttaattacgtttcctttttattttcgtatatttttatttttcattttgttttttaatttcctatgttcctattcatatgaaaagtatattataaaatattttgagaaaagggaaattcaaaagaaatataatcacaatcacatgagtagtattttttgttcgccccaagaactggatactacaaatgttttcgtaacttgtaattag

SEQ ID NO: 392 - DNA, 906 bp, Plasmodium falciparum
atgaaggaaaattatatgattagacacttatttaagaaatatggtttaaaatgctataacagtatgagtaaagggttgttaagtaatataagaaatggaaattctatagtgctatatgaaaaaaatgtaaataagaatttaatgaatttattatataaaaaacattataacacatataaaaatcgagttttcaattcagctatgtataataatacaccttcgaattatatgaacaatccagaaaataataatatgaaccatttacaaaataattctaattataaatatgaaaacccaaataactattatcaaccaaaatataataataatctaaataatgaaactaatgaaaataatacgacgtatcaatatttcagtatattcggaagtacagctatgtgtctaatcaaacccatatttcctgattatataacaaacaaaaacaaagtaactatatatggtaaaggtggatttcaatttgtatttatgagaaaacaaagtaattctaataaatatgacaaaaacaataaaatgaatatatttattaaaataaatagtttatcaaatgttttatctttaaatgatgtagagaaattaaaaaatcctataatcatcaaagggagtaataataactatttaacaattgataaacataaagagaaaaaagatcatattgtaataaaatataaataccaaccttctaatagtcctgaaaacaattttaatgatatgaataatatggatacagacattaatgaaaatatgattattaatgatgttaatgatgaaaagagaaacaattttgaagaattgcatgtaagcttttccttttccgaatttctactctttcaaaaagctgctaacttattattacctcaattaataggatgggcaaaacaatattaa

SEQ ID NO: 393 - DNA, 2661 bp, Plasmodium falciparum
acatacttaaatagatataataaggatggtgattactcagtaaaaatgatttatccttatagctctatttattacacattaagacataacaatgaaattgaatcatcaaaaattgctttaaaaattgtaggagtacaaaaaagttcctggtgtataaatacaataaactcttttattgacaacgttgttatattaccatatagaatatatggagataatttattatcacgtaagactaaaagaaatactaaaaatgaaatatttaaagatgatatgtcgcaaatgtcatatcaaataaatgattcgtcttctgataaattaagttccaaaagtgattctattaattctaataatatggaacgttatataaacgatgatgaggaaaatgataatttattccttggtcataatttgataaataaaaaactatattcctttttaattatacgagataatggtagtagagctattgtgattacggaaaaatataatttggctagaaaaattgttagaaccaaaaattttagtaaaattcataaattgatagctttaaatagtagaaaaaaaatattattatcgcaaaaaaataataataagaaatatatattaaatcgtaatatgaagaattttatttattttaattttccaaatgtaccaataatatataaatttaatatacctagaattacctttacatggatacatagacaagatgttattatagctattcatttaacccaattgaaatataatggacatatatatcctaaagaaattgtaaataacgacattacagaaatgtttacacctataaatatcttaaagaaaaaagaattaaacgaatatgtacaatttgttttcttaaacagttatattaattccatatttctaattgaacaaatacatatagatcattttgtaaaaggtgatattcctgttattttgaaaagtactaatattgaagaagatgaaaaagaaaatatctttttatatatacatataaaacaatattgtgttgattcattaaaacaagcacctatatatcaaagcataacaataaaaatatctcccttaaatgccaatattgaactgttagtaattgaacaattaattgaaataatagaaaaagaaaaacagttattattattatatgaaaagaatgataaatctttaccaccactcgtaagtacatctaaaacagctaaaagtgcaatcaatacaacattaaaaatttattcagataggaactttttacaaatgttatatatggatgaatatataaaacataaaatgggacatgatgtttcggaacaaaatatagaaattgaaaataatagattaattaatagtgtaaacagaattgataatacaagttataaaatgataggtcataaaaaaagagtagataatatatataatgatattaataatatgaacatcaaacctaatgcttattcttattattttagctccactaaagctcgaatgattaaacataataaaattattaatattaataatatatcccctaatatattttcagatgatagtactaaaagttctaattctagtaaatctagtcataaaaataaacaatatattttagaaaagaaaatatgtaaattattattgggttattataaatataagaaaatacataatttaattaataatactttttataatataaataatataaatgatgaactattattaccaataaaaattcaatattttaaaaatagaaaaatttttatgaatgcattttcatcccatttatttttacatccaaatccaagatggatagataacaaaagtaaacctgtttatataagagaatttaaaattcatccaatagaaataattgcatctataagaacatcagaacatcgaatttcaagaagagttttacatatagttgatgctttaccattggatacaccttctatgcgtatacgtttaatatcacaaaaaagaaattatattgtttgtacatgggatggattatttcaatcattacgaatatcttattttagacaattattaagacaatctttaccaagtgcatggttatctaatccatttgctattataaaaggttttataaaagggttgtgtgcattgtataaagaatcggttagaggtgttaaaacaagttccaacttttttgatggttttatgtcaggttttaagtgtggaattattatattagttgttaatactgttggtgggttatttcaatcattgagtcatatgttaaatgtatgtcataaattaatgggtggctcaagacctagacctcctagtattttagattcgatcattttaggattagatggattaattttagatacattctatagaccttgggtttccttagtaacacaacctatcatatctattaataagggaaatagtacttttaaaacaacttgcataattattggttgtattcttcgatgtatcttttcacctgtttttggtttattaaacttttccgcatctataaccgaaggtttcgccaatacattaataggagactttgagcgattttctagagttcaagaacgagcagagtttgagacagaaaagattcataaatccaacacgacatttaaaaagggcaaaacattaaaaaaagtaggaaaaaaaaaggtttaa

SEQ ID NO: 394 - DNA, 903 bp, Plasmodium falciparum
atgtgttctacaaataagaatttagcttgctgcaaaggagataatgttttcgatggacaaataaatggaaatgaatcatacccccaagtagtaaataaacaattaccacctaaggtattagaacccataattcaaaataaaatagttgaaatacccaaagaagtatatcttgaaaagattgtagaagttcctcaaataaaaactgtagaaagaatagtggaacagataaggcccgttattaagtacaaaaatgtgtataaacccaaaattgtatatgttgaaaaagtaaaaaatgtagataaaattatataccaagagaaaattgttgaagttccacaaataaaaactgttgaaaaaattgtagaagtcccagtatatgttaacagagaaagaattattactgttccaagatatatggttgtagaaaaagtaatacccgtattaaaaacatccaaaagagaaagtataatggaagttccagaagttaattgcccacacattgatataagtaaagaagtagaagataaagaagaaataccaattaacgaattaaaagagaaccaaaccataagtcttgctgatgaaaaagaaatccaaatattaaatgacttaactagccaaaaggtagattctaatgcaaccattaatatggaaggtgaacaagatacaactgtagatactattacacaagaaaacttctgtggaacagttagttgtaatttcttaccaaattatccaaacttctccaaaattggaaacccattatgcaaaggaggtccagaaaaagaaaaacgtttttcaagtatcagcatctacaaatcaaaggattcaggattcccaagtataagaattgcaaaaactccacaaatgttccaaagaaatctttactgttcatatgcttaa

SEQ ID NO: 395 - DNA, 1455 bp, Plasmodium falciparum
gtgggtgatgtgaacgatttagaaaagaacttagaattattaaacgaaggatgcgataaagaaattgctttgatagaaaacgaatgtactaatgggaatcgtggtgttataaataattatttggaaagtgtggaattagaaattgatgaatttcaagaagcaatgaatgaatataaaatagatcagatgaataggattggaagtaatttagaaaagaaaagtattgtaggtttaagagattggtgtaatacatatttattagataagaataagatgtatacttttagtgataatatagatgataagatattaaaattaagtagatattattatcagaagaaagattatgtaaaaagtaaacaatatttattattatatattttaaatatatctgaaatgattataaatatatctgaatcatcaaaaatgaaaacatgttattggggtattattagtaatattataaatagtttttttatgaatataaataatgatgattatttattttctaaaaatgaagatggtaaaattatagtcaaagaagatataataaatgaaatgaatgtttgtattgaaagtatagttaaattaagtcaattattaaataaagaaaaggtttcaaaaaatgaaattattttacaaagaagttggttaatacactggtctctaattattattttccatttttttatgtatgttatatatgtaaaaaatacatatccaaaaaataattctttttccatgttacaagattggtttattgatgaaaaaaatttatctattttaaatttaatatgtccacatataattagatattattgtgtttatgctatattctatagaaatagaaaagatcattttgaattaatattaaatacattaaattttattaaatcaaaatacaatgattcttttacatcattattaatatccatatttacagattatgattttaatatggcacaaacatgtatagcaaccatcggtacattatgtgaacgtgatgttttcttatacaaattaaaaccttatattgaagaacattgtagatttattatttttgaaacatattgtcgtattcataaatccattaatattgatatgatttctagtaaagttaatttaacaagagaacaagcagaaaaatggattgtaaatctaatcagaaatgcaaaattagatgcaaaaattaacagcgaaaaaaattgtatcgaaatatctacaccaccacctaatctatatcaacaagttattgacaaaacccaaaatcttatcatgagatctaattttattgtacaagtattaaacagatcttcaaatgatgatcaacaacaaatacaaaaaaatttaagattcaaaaataaaaatgaaaaaaatttaaaaaataacaaaagaaataaaaactttaatcacatgtaccacatcaacaacaaaattgtggcacctgacacataa

SEQ ID NO: 396 - DNA, 366 bp, Plasmodium falciparum
aagaaagaatatgatgtaaagtccaaaatgagcgacaaggaaaaagaaataaaaatggaagaacataatttaatatgcaaatattgggaaaaacaaagtgaatgtatgagtatgttaatagatgagtggaataaaatttcagatatacttgaatccattaatattgatcccaataatattatgagttctttattatcattatatggagaaaaaacagttaacgattttcatttatctcttgaagaaataaaaaaagccaatatagaattaaacgtaaatactgatgatataagtatcccagaaattaatgaagaagatataaataagtttgatccttcgaatatgactatactaaatttaatagag

SEQ ID NO: 397 - DNA, 408 bp, Plasmodium falciparum
ggtattaaacaccgagttgggttattagattatctgaacaaagtagaaataaacttgaacgcctttgcaaaaattattgaagggagaatgatatcaaatgatgacgtaaaaagtcaattattatccatacaagatatgagtgaagaagggttactttcgaagcttttagaaaatttgaaatgtaataaaattgatataaatgctgaatcttttaaaacaccaacttctttttttgtttctcatcacttacctatgacagtatgttcatatagtgaccattcaaataatcatgaattaaaggatatgaatgaaactaatagtaatgctgatattaaagatgatgaaaaaaaagtgactgatgaaaatgatgccatagatactcaaaataaaaatgaacacaacgactaa

SEQ ID NO: 398 - DNA, 546 bp, Plasmodium falciparum
atgagattctccaaagtattttcttttttcgcctttttcattgcccttaaatattttaacagatgccttggtgatcaattagatatgggttccgtacacaataacaattccgttgtaggaaactcatcatcacattcaccatcatcatcatcatcttcaccatcttcttcttcttcttcatcatcatcatcaccatctgcatcttcatcttcatcctcatcatccccagcttcctcatcttcaagcccatcaagcacatcagatgacagcaaaaatgcatccttagataaaatcgatgaagaactccaaaagaaaaagaaaaacgaaaaattacttttaatatcctctattgccacaggtttagccgttttagtaggtggaataataggtactgctttatacgcaagcagaaaatcatcaaaagcctgcaaaaataacgttgacgatttagattcagatgttgaagaagccgatgttaccgaggaatcagctgttgaaaccaagaaagacgaagtcaaaaccgaagaacccaaaaaagaacaataa

SEQ ID NO: 399 - DNA, 1329 bp, Plasmodium falciparum
aatgtacttgtttctaataacaatgacaatagggcagttccatttagcaatatctgttcaagaaacttatgcgaaaaaaaaccactaaatgttgacatgaaatacgtaaaatcaaaatgttgtgattctataagtgaatcaaatatggttgatcgattaaaggtacaaatgcttttgaagaacgcttttgaaactgaagatggaaatgtatttgaacagaaccatgatgtatttaaggatttattaagtgatgacatgtggacaagattccatttaaatttacatgataaatgtgatattaagaatggaaaacacgaaatggataatattatgaataaagaactatttaaattatgtgaacttgatgacaatagagaaaaaatgatgaatttttggaaagaaacttttgaaaatgaaaaaaagaaatacaatcaaatcatttatgacttatatatgtatcttgaattcctaagaagaaaaaataaagtaccacatgagtatgcaggcaagcaatgggatgattgtataaaaaaagtaaaggaaactgaagacaatgctaaagttttattagaagatatatttaatttttggcttgaaaacgaacatttagacaagaacgaatttataaccttaatatctgcatgcagattattatggagaaaattagctgatgatatgacaaaagcttgtaaagtttatatgggtaaaccttttaaggatgtatataatgaaaaaaaaaaaatagtaaatagaggtatagatttatcaaacgttaattatgatgatcattttaaaaatggaaaatttttaaaaaactattctacgcatgaaaatacctacccaactttgaaaacattgttagaaaaatatgctataaccgatgattattcaccaccagatgtatttggtaaatcataccctcctttagttgaagaaatgtcaacttttcaaagtagttcaatagaaaccaacgacgaagaaaacgaaagtattgataataatgaagaaaatatgtctgacagaccaaacagtttatctcatgataaggatcaacacctcgatgaaacacataatgaacaatatggattatacgtaaaagaaatggaatctaaagttgaaaaattagctgaaaatcaagttgaaaaggaatttcaagaggtaaatgaaagatttagtgaggttgcaaaacgatttaaattaaccgagaaaactgtcaacttttatgagctaggtaatgattcacaagacgattctgatgagcaagaagatgaaaatggtgaagataatgacgatgaagaacataatgatgaagtctctaacaatcaataa

SEQ ID NO: 400 - DNA, 1077 bp, Plasmodium falciparum
atatataatcaaaggaaccataacagcaccacacatcatacattaaaaataccaatcactagattattatgcgaatgtgaattatatgaacttgccaactatgataatgaccctgaaatgaaagaagtcatgcaacaatttgaggatcgtacaacacaacgatttcacgaatatgacgaaaggatgaaaactacacgccaaaaatgtaaagataaatgcgataaagaaatacagaaaattatattaaaagataaattggaaaaagaattaatggacaaatttgccacactacacacagatatacaaagtgatgctattccaacatgtatttgcgaaaaatccttggaggacaaaatggaaaaagaatgcttgaaatgtgcacaaaatttgggaggtattgttgcaccctctacaggagtattaggtgaaattgctgcacttgctgtaaatgcctggaaaactgaggcaattgctgccgctacgaaagctgctatagctaagggtacagctaagggtttggctgcaggtgctgctaagggtgtggctgaagtaattgcacaagtagaatcacaatttcgtttatcaactataggtgttaaggaattggggtcaatttttaatgcatcaaattatacgaatgagactttcattagtggatatatttatgctcaatatcaagggtcgcaatgtggatctctttctatgttacttggcaagagcaagcctttttgcacttttgtggaaggacgaatttttgctacatcggtacgtgtaggtaggagtttttcacccgaagattttataaaaacaactgtacaaactatcgtcaaaaatgccaaaactactgctgaagctacaaaggctcaggtggcttccgctgaaaaagcagcagttttagaaacaagcaagaaggctatagaagctacaactactccttactatactcctataatagtatcaatagttgcaatagtggtcataattttaattatggtaataatatataagattttacgttatcgacgaaaaaagaaaatgaagaaaaaactgcaatatataaaattattgaaagaatag

SEQ ID NO: 401 - DNA, 2106 bp, Plasmodium falciparum
atgttttttaacgatggggataaaaataacatgtttaataaaaacaataacatgaataataatagcggaacaaatataaacacaaacgcaaatacaaataataatatgtggaaccttcaaaataataatttaggtaataatacattttttggaaataataatatgacaaatcaaaatgaccttaataagaataatagtctttttggtaatagcccaaataatatgatgaaaacaactggtttttttaacaataatactattggtaatcatccaaacgatataaataaaacaggtaatctttttggtaacaatactggtttaaacagttcaacagatataatgaaaaataatagtttttttggaagcagtatcaatacacaaaatgatttgaataaaaataatatgaacaataataataataataataataatagtaattctttttttggaagtgcatttggtaaaactaatgaattaaataaaggtagtaatcctttttttgggaatactacaactgttaataatgatttaactaaaagtacaggattatttggtaccactactaatagtactactattggtggtattaataataatgctacatcaaatgcttttaatccaaatttattcagtgctgccaaaaaagaagtttttcctgggttttctacgggtattattgggaataatactagcaataattccaatatttttaaaaaaagtaccttgggaagttctatagcattaggtagtcaattaaatgaaggtagagcaactgaatctggtttattttcaaaagaacaattagaagcagccaaacaaatttttgctaactcatcaagttctttatcaagttttaataataaaatgggtactggtacaacatcaaatacagcaatcaatacgaatacaacaacaaatactactactacaaataataataataataataataaattaacatttagtggtggtttttcatcaagttctagtacctttgctaaaagtaatgtaaacccctttcagactatggctttacaagctactacccaaaatgataaatcttcttcatttctaaaaagtaataataataataataatgtatttcattcatcaagtgatccaaataaattaaacacaacaccatcaccatttggtttatcatctattggaaatctaaatacaaacaataaattaaatagctttccagactttagtcaagctaataaaacatttctacaaaatgatagcttattttcccagaaaaataataatagcatttttggtaatacagctaataatacggcaacatcaactggtgttgcaaaaccattagttaccaattttaattctccatttagtgcttttggtaaaacaaataccagtgatatatttaaaactaatactactgcatcaactacaaatgcaactgcaactgcaactcctgctccctttggatcagcatttggagcgcaaaagaataatgatagcttgtttggaaataatgcattcaagctttcgacagaagtaaagtcaaacgaaagcccattcctatttaacaacaacaacaataataataataataataataataatgctacaacaagtactagtacatttaataatgccttttccttatttggaaataaaacagaaactaaaaataatttccttacccctactactaccacaaataataataataataataataataacaatgtagtcaccaatttgttagaaaccaaagtaacgacaacagaaacgactcccactgttcccactttaaacgttttagataaaggagccacaacaaatgaatctgtatctccatctaaattggaacagacagttaatgtagttcaaaaccaaaaggagaaaactacacaaatggagaatgataaggaaaaggagaaagaaaaggaaaaagaaaaggaaaaggaaaaagaaaaggaaaaagaaaaggaaaaagaaaaggaaaaggaaatcgaaaaaaacaatgaaatcgaaaaagacaaagaaaaagaaaaattagatgataataaaaccacaccaacgctaaatgagaaagaaagtaccacacaaacaaaggatgaaagtgtttccaaa

SEQ ID NO: 402 - DNA, 2487 bp, Plasmodium falciparum
atggctaaattgtcattaactattaacaatgttgatgatgatttaaagcgaaagattaagaaggcaaaatttgagggtgttgaagatctgaaacataaaaacaaaaagttgaccatttcttataacccgaaggttgtggattcttatggagtaatagaacgtataaaacatttggatattaatggtgaaattttaaaggatgataatgatataagtagtaagaacggaaatagtttcactttttcaatgtataaggaaggagtagaagaaaatgttgttaagaaggcgaatatatttgatgataatgagaatatgcaaaatacaaataattatattgataataatagtaataattgtaataatttatatggtataaataatagagataattatgataaattagattgtaatggtaataatgcagataacaattttgatcagatatacgatatgaataatatggtgaataattatacttatccaaatggtgaagatctttatgaacagcttgataatgcatatgatgataaaaattataaagacaattataaaaattatgaaaccaatcatcaaaaatgtgaacagaattataaaaattatgaagccattcatcaaaaatgtgaacagaattataaaaattatgaagccaatcatcaaaaatgtgaacagaattataaaaattatgaatccaatcatcaaaatcatgaacagaattataaatcttatggagataattatcaaaattgtaatgtgtctgaaaaaaatgaaaatataaattctaattataatagcacaaataataaaggagatttatatgatataaattattatcctaatcaagttgaaaaggttgaagaatcagaaggcgtagacgagaataggaaaagtagtaaattcagtgttttaaatttatttaataatattaaaaaatcaaaggataagaaaaaaatgaagaaagaaattaagaaagattatttaaatgaagattataataatttagataagcgcattttgttatctaatgatatgtataaaaatgtggagaataaaaactataataatagtaacgataattataatagtaataataattattattatgattataatgaagagaagctgaagaaaaagaattttaatttcagagactatgaaagttatagagataaacaaaatatttacatttgtgaattaaaaatttataatatgacttgtgataattgtgggaaaaaaattattaactttttaaaagataagaaattaattttagaaggaaatagttttgctacagacaataaaataaaattaaaaatcgatatctcatctgatattatacactgtaataataatgtaaaaatgtttgtaaatacaattatgaatgaaataaaagaaagtggatttaataatgatttattagatctttataaagatgataagaatcgttgtaatttatccgaaataacattatacatatacagagatgatataaaaaaatcatataagttattaaaagatattaaaggtattagtaatgtagaatatgatttaaaaaaagaatatatttactttttatatgaccctgaacttgttggaatacgttatattttagaaattttaaagaaaaaaaaaaatgttgatgcttattatgatgaagataaagaaaaatattttagaagtagccaaaataatgaaacaaataatacctggaaattaattgaattgtctatttgtattattataagtattatcattattgttttgaataagtatcaaatgaatatgggttctatgaatggtttttattcctatacaaaaaaattgttcgataatagtaataaaattgatacggataatatcaaacatccatctatttatcacaatataggaaatggtacccctgttgatcaatcgacattagatatatattttgaaaatgtaacaaaaggaaagactttaaatgaatatgttcataaacaaagtcgtcgtgatgaaaaaggaacattttttattaattcaaattttaaatttattaagaaaaacaaggattcccctataaatagaaaatgggtagatgatgatataaagaaaggacaaattttaaatggtaaaaaaaacaaaagtatagaatataataatactattaatatgttaaatgatcaaattgatgcaggtcattataataatcaagaaggtcataaggactatccattggataatgagaataatgtgtctaaatatatagaatgtacaaattcagaaaataggagaaagaattatttattgaatgaaaaggatgatgatgataataataaggaaaaaaatataaataataatgataataataatgatgaaaaaaatgataattttaataatgactacaataaggatgattattatgatgacgaacattatgatattatccccattggtgatttcagaaaaagcgatatatcagaaaaacatccagataataaaaaaggtgataat

SEQ ID NO: 403 - DNA, 2487 bp, Plasmodium falciparum
ttcagaaaaagcgatatatcagaaaaacatccagataataaaaaaggtgataatacaaaaaatggatattctcgttttaggaaacatattaatactaatctaaagaacaagaataataaaaatgagtccgatggagaagaagaaaaaggtaatatagatggtatatatattcttaaacaaaagaatcataaaaaagatatgattaaaggggaagaggaaaataaagataatttttcaaaaaaagaggaaaagtcggataatgaaaattcaaatgaagaaattgataagaattataattatttgaaaagaaaagaaaaggatcataacagttcaaatgatgaggataatataaatgatagtgtgttaaaagaaaacgtaaaggaagaagaaatacatgaaagtagttcaaatgaacaaagtgatagctatttgaaaaaaatagaaaagaaagataataaaaatataagtgttgacaataatgagaatgataattttttgaagaaaaaggaaatgaaggatgtaaataatgaaaatgaagaaaatagggaaagctctagcttattgaaggaaaataaaaagaaagataataaaaatataagtgttgaaaataatgagaatgataattttttgaagaaaaacgaaatggaggatcaaaataataaacatgtcggaagtaatgtaggtgatattgttttgaagaaaaataaaaagaaagataataaaaacacaaatgacgaaaataatgagaatgataattttttgaagaaaaaggaaaagttatataataatagttcaaatgaacaaaatgaagagaatgaaaattttctaaaaaaaaaggaaaatactgataataaaaatacaaatatccaagataagcaaaatgctatttttttaaaaaacaaaaaaaagaaggatgataaaaattccaaggaagaaaatgatgaaagtgataactttctgaagaagaaagtaagaacagaagataaaaatacaaatggtcaagataagcaagatgatatttttttaaaaaataaacaaaatgataatgtcaaaagttcacatgatcaagataaccaaaatgatgatacatttttgaagaaaaaaaaaataaaagataagaatgataattccaatgatgaaggaaatgtcagttcactaatgttaagtaaaaaggaagatgaaaataaatccaaaaataaaaagtgtgatacaaataattcaaaagataatataggtgaagacaaccttggggtgagtaaagaacaagatggtaaggatagccaagatgttaaaggtggtaagcatggacaagatgttaaagatgataaagatgaacaagatgttaaaggtggtaagcatggacaagacgttaaagatgataaggatgaacaagatgttaaagatggtaaacatggacaagatgttaaaggtggtaagcatggacaagatgttaaagatgataaggatgaacaagatgttaaagatggtaaacatggacaagatgttaaagatgataatgatgaacaagatgttaaagatgataaggatgaacaagatgttaaagatgataaggatgaacaagatgttaaagatgataatgatgaacaagatgttaaagatgataaggatgaacaagatgttaaagatgataaggatgaacaaaatgttaaagacgataaggaagacaaagatattaaaggtggtaagcatggacaagatgttaaaaatgataagcatggacaagatgttaaaaatgttaagcatggagatgtcgttaaagatggagaaaatgaaaatgactcatatgacgaaacagaagaagataattttttgatgaagaaaaaagaaaaaaaagatgaaaacagtacaaaggatgaaaaagaaaatatagttatgcgtaaaaataagaatagtgaaatatccaatgaagaaaataatgctacttatgaaaatgaaaatatttttatgaataaaaataaaagttataataattcatataaaaatgaaggaaatgatgattctcttttttcttttaataatttattttacaaattagctaattatagtatttatttagatatggacacaaaaattgttaaaggtttatcattaagattattttttatttttgtattaagttcttttgtatatatatattatggatttagttttgtattgaatggatataagaatttaaagaataatatgattaatatgaatgttttaatttcaattagttcctctttttcgtatttttattctttattacttttgttattttgtttaattttttctattgatttaaatggtattcctttatattttgattcatcagcattgttgatctgtataatgaaatttgggtgtgaaatagaaaattttctagttagcttttccaaaaaaaaaatggaggatttatatgaaagtacggcaaaaaatgtatacatactggagaaaaaaaatagatattatcaagacgaggaagga

SEQ ID NO: 404 - DNA, 2670 bp, Plasmodium falciparum
ataaaaaaagcacctacccctgatgaacatatttatgaaaaaattaatgataaggttcaaatagttagttcgttacaacagcaagttttagaattgttagaagattatgaaaaaaaaaaaaacaatgaaaatgtaattgcacataaaaaggaagttttatctatcgataaaaataatcatgtattaaaagaagatgtacctgatgatgaatataaggaagaaattgaattagaaaaagaagaaaaaaacaattttaaagataaagaagaagaggaaaaattaaatgaatttaataaagaagtaaaaatacagaaatcaaaaccgaaaccgaaaaagaattacaacaataatatatataataataataatgagaagaaggagaaggagaaaaggaaaaatattttattcaaagggggcattggaaaagaagtattaaaattatacttaaaaatttctaaatttattgaagaatataaaaataaattatttaaacattggttatcgtacacaaaaaatatgaacagtttaaatgtaacggttttcgtaaaacatccaaagacaaaaaacattatagtaaatttcgataatagaattaagaaaataataagagaagcaaaaatatttctttcttttgaatttgaattacctgaagaaataaagaatatgatatctcaagaatccaaaatatatagtttttattataaattttataatatattaatattaataaaaaagatgaaaagtaataagaaacttggtattgatttaagtttgaaatatttttttatatatattgatcaattaattttgccattcctagtaaaatatacttggaataattatgccttagaagattcgattgataacttatttaaagaattatattattttgatgaatctataaattctttatattatattataaaagatcatatatattataatataaaattactttataaaatccttgattataaaaatgaaagattggttatacatagacaaaagaaaatgtttaataaaagaataattttatgtaattctatatcgaagaaaattcaaatagctatttttgatattttaagtaatatacaatatgtatatgaagacaaattaaaaagtataataacaaaggaagaaataataaatactagaaattattattatgaaatatttttgtctaccttaaaaaaaatatacttaaaaaatattaagattttaattaatacatggtcaaattttgatgataataataataataataacaaaggtagcacacaaaataatatggacaatatgatgaattataagaacatgaatagtgatataaataataataataataataataataatgattacaattacaattacaatgttgttgaaattttattattaattcaagaaaatgatattattattaatccttccattaaaagcattaaggaaaatataaaaaaaattatcaacgtttctattaataatttaatatatattgataattggataacaacagaagatttaatacgacaatttcatgggaactctgaaaatgaagaagagcatgatatggaagatttatctaataaaacaaaaaaaagagatcaaattaaaaaaagaagcgaacaaaaaaatgaagaaaataaatttttatcaaatgatgaaattaaaagaaaaaagaaaaaaaaaaagaatatatttgaccaagttttagatttctcttatttttcgaaaaataacttgaatgagtcaggaaattctatagaagaagagttaaatatggaaaatgaaaattgtgtggataatttgaattattactttgaattttatgagaaaataagagaagataaaaatatcgaaaaagaattattaaagttaaatgataaattatttgcatttcaaaatgcggttgacaattttattaaaaagtttgaaaagtataaatatattataaaaaatttccacttacaaaaggaacaaaataataataataataacaacaatagtgataataataataataataataataaaagtaatgtgataggggattataataaacaaaaagatatgatgaatgataaaatattagacatggataattatatgaaagatagagaagatgatgaggaaaaagaaagaaacttattaaattttacagaaaatgaagatgatttagaaaatgtaaatatgaagagtagtacaaagggaatcttagacgatgataatattgataatagtgatgataatgacagtgataataataatggtgataatagtgatgacgatgatgatgatgatgataataataataataataataataataataataataataattttaagaaatacaaagaagaagaagagaaaataaaaaaatttatagaaataaaaaaagatataaataacatagaaagttgttatatgctaaatatgtttaaattcaatttagaaagctttaaaatgtatttaataaatattattgaaaatgaagcattagaatgtgctaaaaatgttattgaacctcttaagaaaaaaagtgatatgttaattaaaaaaattaatacattaaaaataaaattaaaaaaaaagattatagacatagattcattatattatgttattaatataataaagaaaatacatatttttgaatcaactattgat

SEQ ID NO: 405 - DNA, 2670 bp, Plasmodium falciparum
gttaagaaatatgatgaaataaaatgtttaaaagaaagtgtggatattggtttgaaaaaattaaacgaggcagctatggacgtacagaaaatgagagaaagtttaacatcggaagaagagaaattaaaagaatccgatgaacaaatgaatatattattagaaaaggtaaaggatgaatcactcaaagcggaaaaacaaagtgtagaagtttctaaatttagagataaatgtattaaggaaaaagatttaattttaaaagatcaagaagaagcagataaagatttaaaagcagctttgccatatttacatgaggcagaagaagctattaaaagtataacaggaaaagatatcactgagttgaaaagtatgaaaacgccatctgatattattagaatagtttttgatggtgtattaatattattacaagggaaattgaaagaacctaaaatcgatgtaaaatatgtcaataaacaacatatagattttatacaagattcttttgatgaatatgcaaaacctctaatggcagatattagatttctaaatttattatttgatttttctaaaaatgagaaagataatattaatgaagaaactattgaattacttaaaccatatattcaatctactttttttaaaactcaaattgctaaaaaggcttctgttgccgctgaagggttatgtaagtgggttggtgctatggctatgtataatcaagcttcaaaaatcgttaagcctaaaatgagttatttaaaaattcaaacaggtagattagaagatgctttaaaacaattagcagaagcagaagattctttgttgaaagcacagttatttgttgaaaatttaaatttagatattgaaaatatgtttaaaaaaaagaaggcgttagaagaaactgctttaaaaactaaacaaagaattgaacaagcgaataaattaattaatggtttatctagtgaaaaagatagatggacagatgattctaataatttttcaaatataaagaaaaaaattgttggtgatgtttttatatgctcttcttttataacatattgcggcatgtttaatacagaatttaggaattatcttatgaatgatgttttttataattatacaaagaatataaaaaacatcccagtatcatctaatatagatattataaaatatgtgttatcttctgatgatacaaaaatatgtgattggagtgtacagaaattaccaaatgataaattaagtatagaaaatgcattgatttgtgaaaatagcaataaatatgtgttattaatagatccccaatgtcaagcaagtaattggattaagaataaagaatttcagaatgacctatctaatcaaaggtgtataactacatttaatagtactaaatttaaagataatttagaatattgtttaagtgaagggaaaacattattaattgaaaatgtcgaggaatatattgatcctatattagattcagttttagaaaaacaaattataaaaaaagggaaaaagaattatatattgattgaaaataatttaataaattttgatgagaaatttaatttatttatgaccactaatatacctaaccctaattatagtcctgaaatttatgcaagatgttgtgttattgattttacagtaacagttaaaggactggaagatcaattattgggtagagtattaacagaagaacagaaacatttagaaataacattgaaaaatattatgatagaattaaaagataatacaaaatcattgcaagatttagataagcagttgttatataaattgaatacaagtagttctaatcttatagaagatgaagaattaatagaagtattaaataatactaaattactgtctaaagaacttgaatcgaaattaaaagatagtaacgaaaagaaaaaagaaatcaatgaaaaaagagaacaatatagaagtgtagcattaagaggaagtatattatatttttgtatcgttgatataactaatgtgaattatatttataatacatctttacatcaatttttggaacaatttgatttatctattaaaaaagcagaaaaaggacagcatattaaaaaaagagtagaatcgatattgtatacattaacaaatttaataatatcatatatggaaagatgcctatttgatcaccataaaattatatttaaattattaatatctttgaaaatattattatatgataacataataagtaataaggatataagtttttttctaaatccgttatctcactatagtccttcaaatgacatgaataatgagatgaccaatacaaatatgttaaatgatccaatgggtgtcttaaaaaataagaagaataagaaaaataataaggaaatgattaataataataataacatgagtatagcaataaacgcggtgataaataatactatggatagtagttctatgaataatgatactatgaatgtttacttgggaaccaatgaaaatgataaaaataagaaggatacaaatacaagtgatgttatgtcatcatcatctagcacaaaaactggatcccgaacgacaacaacaacaacaacaactactactactaataataataataataataataataataataatatggatggtaatagttctaataatgctggagatataaattcatgtaaaaat

SEQ ID NO: 406 - DNA, 774 bp, Plasmodium falciparum
attcaatgccaaaatgtaagaaagagtttagatttagaagtagatgtagaaacaatgaaaggtattgcggcagaaaagttatgtaagatcattgaaaaatttattcttacaaaagatgatgcaagtaaaccagaaaagagtgatatacacagaggtttccgtatcttatgtatattaatatctactcatgtggaagcttataacatagttagacaattattaaatatggaaagtatgatatcattaacaagatatacttcattatatatccataaattttttaagagtgtaacattattaaaaggaaactttttatataaaaacaataaggctataagatattcacgtgcttgtagtaaagcctcattacacgttccatccgttttatacagaagaaatatatatattcctgaaacattcttatcattatatttaggattatcaaatttagtatcttcaaatcctagtagtccattttttgaatatgcaattatagaatttttagtaacttattacaataagggttctgaaaaattcgttctttattttatatctattatatcagtattatatatcaacgaatattattatgaacaactttcatgtttctatccaaaagaatttgaattaataaaatccagaatgatacatccaaatatagtagatcgtatattaaagggtatagataacttaatgaaaagtacaagatatgataaaatgcgtacaatgtatttggatttcgaaagttccgatattttctccagagaaaaagtt

SEQ ID NO: 407 - DNA, 2514 bp, Plasmodium falciparum
atgaagaaagataataagaatttttcaaatacttcaatcggtcttttaaaaaaaaaaagtacaactaaacaggatatttcgaaagttaatgtgaaacataaagataaggcaacaataaaaggaaaagataacattcctgtattatctaaaaaaaataatataaatgataagaaaaaagatataaacatattaaaccattctacaaatataaaggtgaatgagaaagaacgttcaaatttaaatagttcaattataaacatagaacatgatcataaaaatgttgatatcaatggaaaagtagaattggtaagtgacgaaaaaaaagaaaaaatagaaaaaaaagataaaaaaatggaagtggataatattaataagggtgataatttatataatgataacaatattaataaagatgacaatttacataatgttggaaatattaataaagatgacaatttacataatgttggcaatattaataaagatgataatttacataatgttggaaatattaataaagatgataatttacataatgttgacaatattaatcatgttcatgcttcaattagtaataaatttaaaagagaagataatatggatccattaaaaaaagataataatgaaaattttgtatcaaataaattaaatacagaaaaagaagatataacgtataaaataaatgatttagaaaaaaaaaatatattagataataaatgtaacatgaaagatgatgaatataattttgacacattaaacaaaaataatatccatgtggtagacaataatattaaaaatgtaaatgatggaataaatatttttgataattattatgatgataacagtgataggtataatattcataatgtttataatagtgatactaatagtactgataatgatgataataatgataggcatattacagataacgataattataaatatgattatgaggatcaaaaaaatgaaaataagaataccaaggatatagatgaagaaaagaaatgtaatatatatgataatatattaaaacaattaaacattcagaaaaatgaaaatttagaaaatagtcatatcataatttttggaaataaggatgtaggaaaatcatgcttagttaaagcattacaagaaatatgtataaataatgatgaacaagaagattacccattttattgtaataagaatagagttttacctttagattatgcttgtttaaaggtaaaaaatatagatgaaaatagaaaggtgaaagacataaaaagtaatagccatatatggatcttacaacatccatcttatatcaattcattgattaaaaatataaaaaattttaaaaatgtagaaaatgttattattttaatatgtacagatttatacaaaccttataatattatgtctgatattaatagttggatagataccttgtatattttatttgaagcaatacattctaatacaagcttaaagacattgaaccaattaaaagaaaaaatggaaaattatatttatgattacaaaaataaaacaatagaaaagggggaaaaaagagatcatcataaaaatgaagaattaaaagatatacaagaaaaaataaataacaacaacaacaacaaaaacaataatgataataataataataataataatgataatgataatatacataatagtatcaataataataacactattaatatgaataacaataataatataaataatataaataataataacaatattaatagcattaacagggatataaataaaaatatctttactcctgacaaagaacgtttaataaaaataaatttaaccttcccaatattttttattatttgtaaatctgatggatatgaaattttgaacaatagaacgtatcaaggatatatggatgttatcatttcctatttacgtaatttagccataaactatcaggcggctataatatattgtaatacaatcaataaggatcatcctaaaaatatagaacttttgtataaatatataatgcatagattatataactttccttttaacgagaagccaattttaaatgattatgaaaaaatattcataccatcaggatatgataatttggaattaataaataaatcaatcaaaaatacatttgttgaaaatttccataaaccatatgattcaattattattaagcctataccaaataaaagcatcgtcgaacaaaatgaaaatgtagtagatgattattattttaatgatttcttagcaaatttatctaatgatataaacaaaattaaaaagaatgatgaaaatgtaacaacgtggggaaaaaataaaattgatgttattgttaacaaaagtaatatatatacagaggaaactaatgaaaacaatttaaataaagataaaatagatcaatcattacatagcttttttcaaaatctcttagcaaaaggaagatccaaatcacctagtgctcctaatattaacccaacatcattagaaaaaagaaatataaattcatga

SEQ ID NO: 408 - DNA, 840 bp, Plasmodium falciparum
atggaagcttatttaaataaaattgataaaattgaaccgagcgatcaaaaaataaaagaagaatataacaaattcaaatatgatattacaaaacaagctattgaatcgttaagagaaagaatacctaaacgaatcatatttttcaataatttagtaaatgtaaattcggaacctgggagtatattaaatgttaatgatttagatggtgtatcctataaatataaaataaataaaattgaggagaatgtaagaaaaaagcataagggtaataattctagtgatttcgatgaaagagagaaaaagaaagattctttagatggtcatgtaaaacatttttcgaataatgaagatagcaaattaattatagatgataaagttttatatacacattatgtaccatcacataaacaaatatatttagaattagagaaaataaaaacatatgcttctgaacttatagaaattataggaaatattaaattgtggatacaattaaatgtaccaagaatagaagatggaaataattttggtgttggtatacaagaagaagctatacaagaattagcaagggtcgaagaaagtgcattcaatttatatgatgctatagtgaaatattatatggaaagagcaaaaatatctacgaaagtattgaaatatcctaatgtttcagattatcaagaagctgttagggaattagatgaaaaagaatggatacatatcaaaattactattgtagatatgagaaataattatattatgttatatgaccttctttataaaaattgggaaaaggttgttaaaccaaagaatgaagacgcacatcatagaatgacattttaa

SEQ ID NO: 409 - DNA, 1470 bp, Plasmodium falciparum
atggaagttataacagaaaaaccaaaagtacaatttaacttttatgatgaacagaacaatagctataataatagtactgactatccagaattctctaaggatagtaatatagattatcagccttatgtttatacaaatagaaaatttcctttagataaaaatagtgaactaagaagaaaagaatctcctagtagaaaaccaggtttatgtgtcgatgaaatatgtacgtgtggatttcatagatgccctcgaattataaaatcgataccttttgaaggagaaagtaattatcgaagcgaatttggacccaaagctttgcctgaattgccccctcaaatttatatgaaaccaccaaaaccattgccttttgagggacagactaattacagaagcgaatttggtcccaaacctttgcctgaattaccacctcagatttatatgaaaccaccaaaatcattgccttttgagggagaaacaaattacagaagtgaatttgggcccaaacctttgccagaattaccgccaaggatagaaactaaattagtgaaaccattaccttttgaaggtgaaagtaattatagaagtgaattcggtccaaaacctttaccagaattaccacctcagatttatatgaaaccaccaaaatcattgccttttgagggtgagactaattacagaagtgaatttgggcccaaacctttgcctgaattaccacctcagatttatatgaaaccaccaaaatcattgccttttgagggagaaacaaattacagaagtgaatttgggcccaaacctttgccagaattaccgccaaggatagaaactaaattagtgaaaccattaccttttgaaggtgaaagtaattatagaagtgaattcggtccaaaacctttaccagaattaccacctcagatttatatgaaaccaccaaaatcattgccttttgagggtgagactaattacagaagtgaatttgggcccaaacctttgcctgaattaccacctcagatttatatgaaaccaccaaaacaattgccttttgaaggagaaagtaattatagaagcgattatggacctaaacctttaccagaattaccccctagaattgagatgaaactccccaaatcgttacccttcgaaggtgagagtaattatcgaagcgaattcgggcccaaaccgttgcctgaattaccaccgaaaatatatatgcagcccccaaaaccattaccctttgagggtgaaagtaattacaggagtgagtttggtcctaaaccattacctgaattaccaccaagacatgaaactaaattagttaaacagttgccatttgaaggagaaagtagttatagaacagaatatatacgaaaggttcttcctgtttgtccagtggaattattacctaaatatcctacacctacctatccatctcaacatgtattttgggatagagaaacaaaaaagtggtactaa

SEQ ID NO: 410 - DNA, 1176 bp, Plasmodium falciparum
gataataacagctactcatttgaaattgtgaatagatctacgtggttaaatatagcagagagaatattcaaaggaaacgctccatttaattttacaataattccatataattatgtaaataattctacagaagaaaataataataaagattcagttttattaataagtaagaatttaaaaaattcttccaatcctgttgatgaaaataatcatataattgacagtacaaaaaaaaacacatcgaataataataataataatagtaatattgttgggatatacgaatctcaagtacatgaagaaaagataaaagaagataatacacgtcaggataatataaataaaaaggaaaacgaaataataaataataatcatcaaataccagtatcaaatattttttcagaaaatattgataataataaaaattacattgaatcaaattataagagcacgtataataataatccagagttgattcattcaacagattttattggttcaaataataatcatacatttaattttctttcgagatataataatagtgtattgaacaatatgcaaggaaatacaaaagttccaggtaacgttcctgaattaaaagctagaattttttcagaagaagaaaatactgaagtagaatctgcagaaaataatcatacgaattcattaaaccccaatgaatcatgtgatcaaataataaaattaggtgatataataaatagtgtaaatgaaaaaatcatatctataaattcgacagtaaataatgtattatgtataaatttagattcagtaaatggaaatggttttgtatggactttattaggagtacataagaaaaaaccattgattgatccatctaatttccctacaaaaagagtaacacaatcatatgttagtcctgatatttcagtgaccaatccagtacctatacctaaaaatagtaatacgaacaaagatgattcaataaataataaacaagatggaagtcaaaataacaccacaacaaatcattttcctaagcccagagaacagctagtcggaggctcatccatgttaataagtaaaattaagccccacaaacctggaaaatattttattgtctattcatattatagaccatttgatccaacaagggatacaaacacaagaattgtagagttaaacgtgcaataa

SEQ ID NO: 411 - DNA, 498 bp, Plasmodium falciparum
ggagcttttgaggctgaagaagtaggtgttgaatttttactaaaagaattaaagagcgtctccacttcaaccttagccacaaaagtaggtgataagttatcgtccttaaaaagtttgatagcaaaattatacgaaatatcagcttatttgaatgatatattaaatgggaatattgaaatgaatataaaaatattatacaatttacaaaatgtgtttagtcttttaccggatattgaaaacgtcgatttagtacaggcatttatggttaagaataatgacttaatgttaaatatatatataggtagtataacacgatctgttattgctcttcacaatttaatcaataataaaattgagaataaattgaattcggaaaaaaaaaaatctttagaaaatgatatagaaaaggacaaaataaaagataaggaaaaagaaaaggaaaaggaaaaagataaggaaaaagaaaatgataaggcaaaaaaggacaagaaaaattaa

SEQ ID NO: 412 - DNA, 1884 bp, Plasmodium falciparum
attgagggacccgttattggtattgacttgggtaccacttatagttgcgttggtgtttttaaaaatggaagagttgaaatattgaacaatgaattaggtaatcgtattaccccatcatatgtttcttttgtagatggagaaaggaaagttggtgaggcagctaaattagaagccacgttacatcctactcaaacagtttttgatgtaaagagattaataggaagaaaatttgatgaccaagaagttgttaaagatcgttctttattaccatatgaaattgtaaataatcaaggcaaaccaaatattaaggtacaaataaaggataaagatactacatttgctcctgaacaaattagtgctatggttttagaaaaaatgaaagaaatagctcaatcatttttaggtaaaccagtaaaaaatgcagttgttactgtccctgcttattttaatgatgctcaaagacaagcaacaaaagatgctggtactatagctggattgaacattgttcgtattatcaatgaaccaactgctgctgctttagcatatggtttagataagaaagaagagaccagtattttagtatacgatttaggtggtggtacttttgatgtttctattcttgttattgacaatggtgtttttgaagtatatgctactgctggtaatactcatttaggaggtgaagattttgatcaaagagttatggactattttataaaaatgttcaagaaaaaaaacaatatcgatttaagaactgacaaaagagctattcagaaattaagaaaagaagttgaaatagcaaaaagaaacttatctgttgttcactcaacacaaatcgaaattgaagatatagttgaaggacataatttttctgaaaccttaacaagagccaaatttgaagaattaaatgatgatttatttagagaaaccttagagccagtaaaaaaagttttggatgatgctaaatatgaaaaaagtaaaattgatgaaattgttttagtaggaggttcaacacgtattccaaaaattcaacaaattatcaaagaattctttaatggtaaagaaccaaatagaggtataaatcctgatgaagctgttgcttatggtgctgctatccaagcaggtattattttaggtgaagaattacaagacgttgttttattagatgttactccattaactttaggtatagaaactgtgggtggtattatgacacaattaattaaaagaaatactgtcatcccaaccaaaaaatcacaaaccttttcaacatatcaagataaccaaccagctgtcttaattcaagtttttgaaggagaaagagcattaaccaaagataatcaccttttaggaaagtttgaattatctggtattccaccagcacaaagaggagtacccaaaattgaagttacctttaccgtagacaaaaatggtatcttacatgttgaagctgaagacaaaggtacaggtaaaagtagaggtataactattactaatgacaaaggtagattatcgaaagaacaaatcgaaaaaatgattaatgatgcagaaaaattcgcagatgaagataaaaacttaagagaaaaagttgaagccaaaaataaccttgataattatatacagagtatgaaagcaactgttgaagataaagataaattagctgataaaatcgaaaaagaagataaaaatactatcctttcagctgttaaagatgctgaagattggttaaataataactcgaatgctgattctgaagcattaaaacaaaaattaaaagatcttgaagctgtatgccaaccaatcattgttaaattatatggtcaaccaggaggaccttcaccacaacctagtggagacgaagatgtagatagtgacgaattataa

SEQ ID NO: 413 - DNA, 1191 bp, Plasmodium falciparum
atgaattattgtaaaaccacgttccatatatttttttttgtcttgttctttataaccatttatgaaataaaatgtcaactacgctttgcgtctttgggtgattggggtaaggatacaaaaggtcagatattgaatgcaaagtattttaaacaatttataaagaatgaaagagttacatttatcgttagtcctggatctaatttcattgatggagttaaaggcttaaatgatccagcatggaaaaatttatatgaagatgtttattcagaagagaaaggagatatgtacatgccattttttacagtattaggtacaagagattggacaggaaattataatgctcagttattaaaaggtcaaggaatatatatagaaaaaaatggagaaacatctattgaaaaagatgcagatgctactaattatccaaaatggattatgccaaattattggtatcattattttacacattttacagtatcaagtggaccatctatagtaaaaactggccataaagatttagctgctgcatttatttttatcgatacatgggttttatcatctaacttcccatataaaaaaatacatgaaaaagcttggaatgatttaaaatcccaattatcagttgctaaaaaaattgctgattttataatagttgttggagatcaacctatttattcatctggttattctagaggtagttcttatttagcttattatttattacctttattaaaagatgcagaagtagacttatatatttcaggacatgataataatatggaagtcattgaagataatgatatggctcatattacatgtggatctggttctatgtctcaaggtaaatcaggaatgaaaaattccaaatcactcttctttagtagtgatattggtttttgcgtacatgaattatcaaataatggtatcgttaccaaattcgtcagtagtaaaaaaggagaagttatatatacacacaaacttaatatcaagaaaaaaaaaacactagataaagttaatgccttacaacactttgctgccttacccaatgtcgaattaacagatgtcccatcaagtggacccatgggaaataaagatacctttgttagagttgtaggaaccattggtattcttataggctccgtaattgtttttattggtgcttcctcttttttatcaaaaaatatgaaataa

SEQ ID NO: 414 - DNA, 1620 bp, Plasmodium falciparum
atgagtatgtgttgtcaacaattaaccatgtcttttccaactgttgatgatgcaaaatatgtgtatgatcaactagccgttattgcaccacttttccttgctcttactgcatgtactccctatttaggtgggtttctaactgaaacagatacaagatggagagtaatatctaacagtgttgattgtagaacggaagaagaattatcatatatatgtaaaccaagatattcaggaatatccttatatatatccaatgagttacctttaaaaagaaattactatttttataacgatgtagatgtaatacttgacaaaaatgtgtatgacaaattgaaaaaggaaaacgtggatgaatatttagctagacatatagcatctttatttgtaagagatccaattgttgtttttgaaggttcctatagtgaacgtgacattgctacaattcagaagaaaataatggaattgtcaaacgatgaagataaaattaaaggtatggtagaagggtcatcatcaaatagtttgtcatcaaaagttttgttagacaatgaggataggaataaaaatgatagtagtataaaagaaatgaataaatctaatgataataaccataataataattgccatattgaatataataataaaaaagatataaatatgaataagatatatttaagtgataattttgaatttatagaagattatgaagaaaaggttttatcatctcatcaacattttgaaaattttcaaagtactaattggaatagtgtacgttttaagccacctccaattcttgataatcattttaaaggacctagttcaattggatggagagttgaatttagaactcctgatattcaaattaccgattttgagaattcttgtgttgttacattagttatgttattatctaaatttatattaaaagaaagattaaatttatatattcctatgacattgttagaagaaaatttatttagagcatccaaaagagaagctttaacaaaagaaaaattttatttccgtaaagatctaagttatgataccttgaataatgaatttgaggaaaaaagtatatatgatatattttttaatgaaaccaatggattgtttttcttatgttacaaatatgtggacgaactatttaaagaaggattattaaatcaatcagccaaaaataaaatagatgaatatattgaattcgttaaacaaagatgtagtggaaaaatatgtacaggtgctatgtatttaagaaattttatattaaatcatccagcttatgaaaaaaattcttatatcaatagtaaaattaattatgatatatgtaaattaatagctgatattggaaagggattaatcataccacaagaattattaggtgtttttgtcgatccatataaagaaaggataaaaagtgatataaggcaaattaatgaaagccaatacctgaagtccttggcatataaatatatttcaggagaggattatacgcaatacttgctacttaatgaagtacttaaggatgaccaggattattgtacatgtaccagacgtacaatttatgaggaatctatggataatacagtggagtttgcaaaaaaaatgtacgaactgagtgcataa

SEQ ID NO: 415 - DNA, 1053 bp, Plasmodium falciparum
ctgaatcttattgaaaacattcgacaggggacattcgactacaaggatctcagagaagtttattttatgaacgacaatgatttgttcagcatgttaaatgataagaaagcctcagaagaaaaagggaaaggtaaagaagacgcacataataataataatattgataataagatatgtaataatgataaggtaggtgataaaaataaaaagttaagtaataataataataataatggaaatgatttaaatatacagattgaaggggatcagaattataattttaataaaaataatgagactaatatatttgttcttgataatgatgtagataaagtatgtattattcgcttcccattttctgtttcaaaagatatcaaaaaatatttattaaacaaaaatttagatatggttattcaacctactactttattaaattcaagattttttcttattcattttaaaaatataaataaaaaatttcatggaattctattagaattatctacacatatcgagatacataaaacattagatagaaataatttatataaatctaatgatgtttctcaaatgatttatgtatatgaacataatacaaatagtaaagaactcttgaaaaaatttataaataataatttcgaactatgcggaggaattagtaaaaaactcaatcatttcatttttcaaaatcatacaaaattattcaaatatcatgatatatattttgctgaaaaacttatatatgaatatttaaatacaccatattatgattattttgatttatatgtaaaaacattaaatgaaatgcataatcatataattatggaaaaagaaaataataataaacaaaatgaaattgttgacgaaacaacggatcttgcagctatcctgggatccttagataattcttataatattatgaatttaattgaaaaacaagatggagatatagatttcgaagcattattaaattatgatatagaaaaggaaaattacgaatcggacgtctccgacttattactgggcggcacatattatttacaaaagaagtaa

SEQ ID NO: 416 - DNA, 2610 bp, Plasmodium falciparum
atgaagatcatattctttttatgttcatttcttttttttattataaatacacaatgtgtaacacatgaaagttatcaagaacttgtcaaaaaactagaagctttagaagatgcagtattgacaggttatagtttatttcaaaaggaaaaaatggtattaaatgaagaagaaattactacaaaaggtgcaagtgctcaaagtggtgcaagtgctcaaagtggtgcaagtgctcaaagtggtgcaagtgctcaaagtggtgcaagtgctcaaagtggtgcaagtgctcaaagtggtacaagtggtccaagtggtccaagtggtacaagtccatcatctcgttcaaacactttacctcgttcaaatacttcatctggtgcaagccctccagctgatgcaagcgattcagatgctaaatcttacgctgatttaaaacacagagtacgaaattacttgttcactattaaagaactcaaatatcccgaactctttgatttaaccaatcatatgttaactttgtgtgataatattcatggtttcaaatatttaattgatggatatgaagaaattaatgaattattatataaattaaacttttattttgatttattaagagcaaaattaaatgatgtatgtgctaatgattattgtcaaatacctttcaatcttaaaattcgtgcaaatgaattagacgtacttaaaaaacttgtgttcggatatagaaaaccattagacaatattaaagataatgtaggaaaaatggaagattacattaaaaaaaataaaacaaccatagcaaatataaatgaattaattgaaggaagtaagaaaacaattgatcaaaataagaatgcagataatgaagaagggaaaaaaaaattataccaagctcaatatgatctttctatttacaataaacaattagaagaagcacataatttaataagcgttttagaaaaacgtattgacactttaaaaaaaaatgaaaacataaagaaattacttgataagataaatgaaattaaaaatcccccaccggccaattctggaaatacaccaaatactctccttgataagaacaaaaaaatcgaggaacacgaagaaaaaataaaagaaattgccaaaactattaaatttaacattgatagtttatttactgatccacttgaattagaatattatttaagagaaaaaaataaaaaagttgatgtaacacctaaatcacaagatcctacgaaatctgttcaaataccaaaagttccttatccaaatggtattgtatatcctttaccactcactgatattcataattcattagctgcagataatgataaaaattcatatggtgatttaatgaatcctcatactaaagaaaaaattaatgaaaaaattattacagataataaggaaagaaaaatattcattaataacattaaaaaaaaaattgatttagaagaaaaaaacattaatcacacaaaagaacaaaataaaaaattacttgaagattatgaaaagtcaaaaaaggattatgaagaattacttgaaaaattttatgaaatgaaatttaataataattttaacaaagatgtcgtagataaaatattcagtgcaagatatacatataatgttgaaaaacaaagatataataataaattttcatcctctaataattctgtatataatgttcaaaaattaaaaaaggctctttcatatcttgaagattattctttaagaaaaggaatttctgaaaaagattttaatcattattatactttgaaaactggcctcgaagctgatataaaaaaattaacagaagaaataaagagtagtgaaaacaaaattctagaaaaaaattttaaaggactaacacattcagcaaatggttccttagaagtatctgatattgtaaaattacaagtacaaaaagttttattaattaaaaaaatagaagacttaagaaagatagaattatttttaaaaaatgcacaactaaaagatagtattcatgtaccaaatatttataaaccacaaaataaaccagaaccatattatttaattgtattaaaaaaagaagtagataaattaaaagaatttataccaaaagtaaaagacatgttaaagaaagaacaagctgtcttatcaagtattacacaacctttagttgcagcaagcgaaacaactgaagatgggggtcactccacacacacattatcccaatcaggagaaacagaagtaacagaagaaacagaagaaacagaagaaacagtaggacacacaacaacggtaacaataacattaccaccaacacaaccatcaccaccaaaagaagtaaaagttgttgaaaattcaatagaacataagagtaatgacaattcacaagccttgacaaaaacagtttatctaaagaaattagatgaatttttaactaaatcatatatatgtcataaatatattttagtatcaaactctagtatggaccaaaaattattagaggtatataatcttactccagaagaagaaaatgaattaaaatcatgtgatccattagatttattatttaatattcaaaataacatacctgctatgtattcattatatgatagtatgaacaat

SEQ ID NO: 417 - DNA, 2607 bp, Plasmodium falciparum
aatattcaaaataacatacctgctatgtattcattatatgatagtatgaacaatgatttacaacatctcttttttgaattatatcaaaaggaaatgatttattatttacataaactaaaagaggaaaatcacatcaaaaaattattagaggagcaaaaacaaataactggaacatcatctacatccagtcctggaaatacaaccgtaaatactgctcaatccgcaactcacagtaattcccaaaaccaacaatcaaatgcatcctctaccaatacccaaaatggtgtagctgtatcatctggtcctgctgtagttgaagaaagtcatgatcccttaacagtattgtctattagtaacgatttgaaaggtattgttagtctcttaaatcttggaaataaaactaaagtacctaatccattaaccatttctacaacagagatggaaaaattttatgagaatattttaaaaaataatgatacctattttaatgatgatatcaaacaattcgtaaaatctaattcaaaagtaattacaggtttgaccgaaacacaaaaaaatgcattaaatgatgaaattaaaaaattaaaagatactttacagttatcatttgatttatataataaatataaattaaaattagatagattatttaataagaaaaaagaacttggccaagacaaaatgcaaattaaaaaacttactttattaaaagaacaattagaatcaaaattgaattcacttaataacccacataatgtattacaaaacttttctgttttctttaacaaaaaaaaagaagctgaaatagcagaaactgaaaacacattagaaaacacaaaaatattattgaaacattataaaggacttgttaaatattataatggtgaatcatctccattaaaaactttaagtgaagtatcaattcaaacagaagataattatgccaatttagaaaaatttagagtattaagtaaaatagatggaaaactcaatgataatttacatttaggaaagaaaaaattatctttcttatcaagtggattacatcatttaattactgaattaaaagaagtaataaaaaataaaaattatacaggtaattctccaagtgaaaataataagaaagttaacgaagctttaaaatcttacgaaaattttctcccagaagcaaaagttacaacagttgtaactccacctcaaccagatgtaactccatctccattatctgtaagggtaagtggtagttcaggatccacaaaagaagaaacacaaataccaacttcaggctctttattaacagaattacaacaagtagtacaattacaaaattatgacgaagaagatgattccttagttgtattacccatttttggagaatccgaagataatgacgaatatttagatcaagtagtaactggagaagcaatatctgtcacaatggataatatcctctcaggatttgaaaatgaatatgatgttatatatttaaaacctttagctggagtatatagaagcttaaaaaaacaaattgaaaaaaacatttttacatttaatttaaatttgaacgatatcttaaattcacgtcttaagaaacgaaaatatttcttagatgtattagaatctgatttaatgcaatttaaacatatatcctcaaatgaatacattattgaagattcatttaaattattgaattcagaacaaaaaaacacacttttaaaaagttacaaatatataaaagaatcagtagaaaatgatattaaatttgcacaggaaggtataagttattatgaaaaggttttagcgaaatataaggatgatttagaatcaattaaaaaagttatcaaagaagaaaaggagaagttcccatcatcaccaccaacaacacctccgtcaccagcaaaaacagacgaacaaaagaaggaaagtaagttccttccatttttaacaaacattgagaccttatacaataacttagttaataaaattgacgattacttaattaacttaaaggcaaagattaacgattgtaatgttgaaaaagatgaagcacatgttaaaataactaaacttagtgatttaaaagcaattgatgacaaaatagatctttttaaaaacccttacgacttcgaagcaattaaaaaattgataaatgatgatacgaaaaaagatatgcttggcaaattacttagtacaggattagttcaaaattttcctaatacaataatatcaaaattaattgaaggaaaattccaagatatgttaaacatttcacaacaccaatgcgtaaaaaaacaatgtccagaaaattctggatgtttcagacatttagatgaaagagaagaatgtaaatgtttattaaattacaaacaagaaggtgataaatgtgttgaaaatccaaatcctacttgtaacgaaaataatggtggatgtgatgcagatgccacatgtaccgaagaagattcaggtagcagcagaaagaaaatcacatgtgaatgtactaaacctgattcttatccacttttcgatggtattttctgcagttcctctaacttcttaggaatatcattcttattaatactcatgttaatattatacagtttcatttaa

SEQ ID NO: 418 - DNA, 777 bp, Plasmodium falciparum
atgataatttggtttattcaaccaacgattttttacataatttttatcttagcacgaaatatacaatgtacctacaaaggagataatataaatgaaataaaaagcatattagacaatgatgagttatacaatagcttaagcaatttagaaaatctgttattgcagacattagaacaagatgaattaaagattccaataatgaaaggtgatcttgataagtatttaaatatgtcaaattttaaaatacttaatgaattaaatgctgatggagcagaaaagccatatataatacctacatccaattgtagtgctaatgatatagtaaaatatgaacatactttaaaaactcaaataactctagaatataaacccgaaatatctgatatgcttaaaaggaaaaatattgttgttagaacattaaaaataataaaatttatgcaaacaccaatgagtgcttataaaaatacaaataatataaaacaatctttattagaaatgaataaactttttacaaataaagaaaaaaaattaaacgaacatactattaatgcattaagactcagagacaggatattcaataccaataatttaactcatagatctattaaaaagggtatctctacatacatgccaatagacacgaaatctgatataattgattatgatgaccttttatttacgaatcatccaagtattgaacttatggaaaatctagataaattagccaattactatcatataggaatatttaatatgattggttcacattatatagct

SEQ ID NO: 419 - DNA, 1953 bp, Plasmodium falciparum
ttattaaattctataaaggagaatgccaactcgaaacttcctgctttattatggaataaaataatagggaagggaaatgataatgaagtaaattttgaagataagaaaatgatagaaggtaacaaatctggtaatggagaagagcacaataaacataaaagaagacaagtagacaatcaagaagatgattatgatgttgatgaatatggaaatccaaaatcgggtgctccatacaagagcgaagaagaacatgcagaacaacaaaattattatggagaacatcacggagattatgaagacaaaaacgaatatcatggaaaatccaatatagaaaataataaagattttccagaacagggacaaaaagacgaagaaaaagaaaaagaagcaaaaaaaaaagcggaagaatttgaaaaaagaaaacaactacatgaagaagaaaaaagaaaagctagagaaacacaacaagccttacataaaaaattacaagaacaattacaacgattaaaagaacaagaaaaaaagaaagtggaacaccaaaagttaatacataaaattaaaacacaaggtgatgtagatccagcagtgcaaaaagtacttaacaagtataatcaaaaagaaaaagatgaagaacaacagatacttaaaataagagacttacaagtacaattacgtcatatccaacaaagaattcaaagtctaaaatctactaataatggccaaccaaaaacaaaagatgaatatttacaattaaaagatctacaaaaagaatattatgataaagaacaagatgaacaaaatatgatagaacacttagaacacttacaaggagaaatgcaatacttatatgaagaattacaaattgtatatgatgaaaaccaagcaaaaacggcgcaagcaaaagatgaacaacatgaattgaaaccacaagctgaaaaagatgcatcaaaactaacaacaacatatgatcaaacaaaagaagtaaaaccacaagctgaaaaagatgcatcaaaactaacaacaacatatgatcaaacaaaagaagtaaaaccacaagctgaaaaagatgcatcaaaactaacaacaacatatgatcaaacaaaagaagtaaaaccacaagctgaaaaagacgcattagcaaaaacagaaaatcaaaatggagaattattgcctcaagctgaaaaagatgcatcaaaactaacaacaacatatgatcaaacaaaagaagtaaaaccacaagctgaaaaagacgcattagcaaaaacagaaaatcaaaatggagaattattgcctcaagctgaaaaagatgcatcaaaactaacaacaacatatgatcaaacaaaggaagtaaaaccacaagctgaaaaagacgcattagcaaaaacagaaaatcaaaatggagaattattgcctcaagctgaaaaagatgcatcaaaactaacaacaacatatgatcaaacaaaggaagtaaaaccacaagctgaaaaagacgcattagcaaaaacagaaaatcaaagtggagaattacttactcaagctgaaaaagatgcattagcaaaaaaagaatctgaagctccaaaaggttcatcaacatcagataaaaacacaacggaaaaccaattaaatgcagaagcacaatcagaagtaaaaccacaatggcaaaaagactattggaaatcaaaaaatgagtcacaaacagaaacaaataatacatggaaaaaagattcatggaaaaaaaaaacagaagaacaacaaaatgcagaagctcaacaagaagtaaaatcaccatatgaaaaatattcatataataaagaaactaaaccacaaaatgataaatacacattaaacaaagaagtaaaaccacaaaatgaaaaatacacatacaatcaaaaagtaaaagctgaaaatactgaatcagaaaaatcattactagaaagttctgtatttaattaa

SEQ ID NO: 420 - DNA, 969 bp, Plasmodium falciparum
gtgtatagtaaaaacaaaccatccatcacatcacatcatacacaaaccaatagatcattatgtgaatgtgacacacaatcgacaaattataataatgatgaggaaatcaaatcagtgaaggaaaatttcgatcgacaagcgtcgcaacgttttgaagaatacgaagaacgtatgaaagaaaaacgccaaaaatgtaaagaacaacgtgacaaaagtatacaagaaattattgaaaaagataaaagggaaaaatcattagcacaaaaagtagaaaaaggttgtcttatatgtgggtgtgggctaggaagtgttgcaggaagtgttggaatatttggtacagttgcagtaaaagagttgacaaaagctgctattgctaaggcagttgtagtcgctaaggaagcaggtatggctgccgctaaagctgagggtgctgcggcaggtaaggaatttgttattgcaaaattacaagaaatgggtatatcaactgtaggtgttcagggattgcaatcctattttgttacaacggattatactaatgccttaacgatttttcgtgctataaataatcaatacagcccatcgtcatgtatatttgtttcctctggcactcgtcaggctttttgcacttgggtgaccgaacaatctaaatctgtagcgaatattcgagagatgcttcaaggtaattccgtttcatataccaaagttacagaaaaagctgtaggaactatcgtcacagatgccaaaaaagctgctggagaagctacagaaaaggctattgaagaagttatacaaagaagcactgctgcagcagaatctacatatgctggttgccagagtgctattattgcttctgttgttgcaataataattatagctttagttatgataattatatatttagttttacgttatcgtagaaaaaagaaaatgaagaaaaaagccgaatacacaaaattattaaatcaataa

SEQ ID NO: 421 - DNA, 567 bp, Plasmodium falciparum
tttatttctgataagcctttgaatattcatgtttctatatatataagtacaatatatgtggatataatattaaatatgttaattacaattttcagtttttataaagtatatttgatatcagtaaataaaattactttttttgaagataatatagtgaatcgttattttttttattgtttaacatcagtaaatatatttttctgtttcatttcgacagtattaaatattttttgtatatattacacagaacgatttaagacatttttaagattatcttcaaaggatgatgaaaaaaataaaatatcttttcgtttgaatagcttgagatatccccaaggaaatagtatgaatgaatatacaaatgaaaagaaaaaaaaaaaaaagaaaaaaggagaaaatgtaatggacggaaattttgaaatgaatagtgcagatgagaagaataattatatgagtaatgaaaccaaatataatagtaggaattttatatatgattttgatcatagaaatcaggacaataatgaaaaggttaattatttaaataatggagataaaaatatagtatga

SEQ ID NO: 422 - DNA, 1875 bp, Plasmodium falciparum
atggcaaaacaaagattaacagcactcgacatacgtgccattgttacattatgtaaaaagaatatcgtcggatgtattgtaacaaatatttacaatatttctaataagatatatgtgataaaatgttcaaggaaagaacaaaaactttttttcctggttgaagcagaaaagagaatacatataacggaatggaaaagagaaaaggatgtgatgccttcatcatttactatgaaattaagaaaacatttacgttcacgtaaaatttcgaatattaaacaattaggagctgatcgagttattgatatacaatttggatatgatgaaaaggcaagtcatttaattgtagaattatatattgcaggaaatataatattaactgatgagaattataagatcctgagtattttaaagagtaatgatactgttatgggcaaaaaatataatgtgaatgatatatataatgtggaagaacacatgtctgttttattatataagaatttgaaaggaccagatgataaggaatatttaaaaaaatgtataatggaaatattgttatattataataatattaatatggatacattaattttgaaagatggtgatgaaatatctaataatataaataacgtttctaatgttcacccgaatggtatattaaataatggagatattgaagaatataataaattgtgtttgaaaaatagtggtactgtaccaaagaagaatggtaataataatgataataaaatgttaggcacaaaggggaaagagaaatgtaaaaatgaaaataataaaaataatgaaagtaataaaaataatgaaagtaataaaaataatgaaagtaataaaagtaataaaaataataaaagtaataaaaataataaaagtaataaaaataataaaagtaaaaacaataatgataaggttgaaaatgctaattgcagtgataatgaaaaaatgaagaaggtaaaaaaattaaaaacattatgtgatttagcttctaaattaatattattcgcgcataacgatttaataatacattcctttttggagtgtgaggtaaatcctttagatttattagaaaactatgatataaatagattatgtgaaatattttgtcatgtaatagaggagtgcttatcaatattaaataagttaagtgatgaaacgtgtacgataaagggatatggtttttataatatagaaaatgacactaataaaaagattaataataataataataataataatatgtgtaatatgaataaaaaggatcaagataatgataaaaaagaagaatataatttcacggagttctctccaattattcttaagaatcatgaaatgaaattaaatgagggcaaaataaaatatatatcatttgatgattataatttatgtgtggatacatatttcagtaaattggaattatcaaaatatgataagcagcaagaaataactaagagtaaaaatgcaataacaaaggtagataagataaaattagatcatgaaaggagaattgaacaattagaaaaagaagtattattattaaaaaagaaaataactttaatacaattaaatgatgtattaatcgaagaaggaattaaattaatgcgttcagcactttctacaagtgcaaattgggaaaaaatatgggagcatataaaaatatttaagaagcaagaacatccaatagcagtgcgtataaaatcggtgaattttaagaattgtgaaatggattatttattaagtgactgtgatgataggaaaggtaataaaatgggtgatgatggtgatgataacgatgatgatgatgatggtgatgatgataacaataataacaataaatcatgtgtgaaacctaaaacgtttgct

SEQ ID NO: 423 - DNA, 2037 bp, Plasmodium falciparum
gcagaagaaaaaattaggaagacaaaaatggctaccgattttgctgttaaaaaagttgaaaagaaaaagaaaaacaaagataataataaacaaaaaggaaaagccaaatcaagtgttggtcaaattcaaaagttaagaaaagtgtattggtttgaaaaatttcattggtttatatcttctgaaaattatttagtgattgctggaagagatgctttacaaaatgaaatattatttagaagatattttcagaagaatgatatttatgtacatgcagatatacacggtgcagcatcttgtattattaaaaacccttataaggatacacctattcctgacaagactctttctgaagctggtcagttggctatttgtcgaagttctgcttggaacaacaaaataattacctctgcctggtgggtatattacaatcaggtgagtaagtcggctcctagtggtgaatatttaaaaacgggttcttttgtaataagagggaagaagaattatttgcctcatgtaaaattggaaatgggcttttgtgttctttttcaaattgaaaagaatgaagacttgaatgtggaaaaccttcctttggaggagaatactatagatattgatgatataaaaagggaggatgacaaaggtgatgacatggcacataataatatgataaatgggttagataataatgtatgtgataatattcctgctaataatgataagaaccatgtggataataagaataatgttcataattatgtgaattatttaaacaacatttcagttcattatacaaatgaagagcatggtattggaattactgaagagaaaataaaagaaaatgattctgtaaaatatttggtaccaaacaaatttaataacatttatatcttggaaaaaaataatatgttgaatgtttctgttataaaaggaacgaacgagaatgaaaagaataaaagcagagatatgtatataaaaatattgtataatatattaagtgatgatatatttaagacagattttttccataaatctgttttggcttggtataatataaaatcaaagagttatatattaaaaagaaagaaaaatggaaatgcatttaataaatatatatactacttaacaagaaataagaaagatatatataatatgatttgtattttatatcctttagtaatatataatatattaagaaaaatgaataatcctacttatatttataaaagtaaatatgttagtaatatatatgttaacaaattttatcatacgttttgtaaaataataaaatattttttccacatttataatatattaattagaaaaggtgatagatgtttcaaaagggaaagttttttttttgaaatatataaatataagaattatataataaatgtattttttaaaggattaaggggtaaaagaatattggttgatagtatatataattttcttatttttctggatagcacattgtatgaaagatgcaaatcgtcgcaggttgtaagtaatatattttctttgtcatgttataataaagatgtagaaaaggataattgtggaaatgtatataaaaatatgtatatggagaagagtatagattttgtaaataagaagatgttaaattatataataaattataaggagaattctaatatcgagaattacgattatgatattaatttttctaaggaaaaggctttgtttgttgcatgcgaggtttatggtaggcccgtaacgtttaaagaggacagtgatgaagaaatagtttgttcggagaaaaagaatggaaatacaacaaatgaggaagatgttaattctttatgtagtagtaattatagtgaaattagtgatactaataaaggaaataagaaactgaaaaagaagaatgtaacatttttatgtgatgatgatgaggataagagggatgtgtcgagggtttcgagaccaagggaacttacgggttttataaaaacggatgttaataaattattgaaagagatcgagagtgacgagaactcgaatattgggaatataaat

SEQ ID NO: 424 - DNA, 717 bp, Plasmodium falciparum
gctgataacatatcagaggaaaaagattatcacatatccaactatttaattaatccaaataaaaacaaaaatgatttatcagaagatgatcatacacaacatactgattttcaaagcgatgataacagtaaagaaggttcttataatttttcggaaagtgataaagaggaatatagaaataataaaaaaaaagaaaaacatggaataaaacgaaaaagacatgattatagtccctacattttttcaataaaagatgctcttctttataaatgtaaacaaataaatgaacaaaattatttaccattagaattaattggagtctatataaaatattgtaggaaatatattttccccaaattatctgaagatgccaaaaaatatatccgtaaattttatttacatcttcgtaatttagctaatactcacaatgatataagtgtacccataacaattagacaactcgaatcattaattagattatgtcaagcaagagcacgagcagatttatcacacatggtaactctaaaacatgcaaaagaagtagtagaaatatatcagaaaacaatattttatcctttacacttaaaaacattgaactttaaagaaaaacctactacaaaaaaaaataaaggaaaatccctcgcagcattatcgcacgtatttaagcaaaaaataatagagcaagccaaactaaaacacaaccaaatatataacaaa

SEQ ID NO: 425 - DNA, 2394 bp, Plasmodium falciparum
atgagttctcaaaataataataaacagggtggacaagatattaataataaaaaagacagtgatgacataaaaccttctgtaagcaaagaagatttaataaattcattaaaaaatgatgaattaaataaaaatacaacgatggatcaaaacgacatgaaaaaaaatgaaaatatgaatattaagaaaaatgaagttttaaataattccaataatgtagaagacggagataatgaaaattcgaaatttatgaataaaagtaaagaaggattgaataatataaatggagaaaagaatgatgacaataattctattgtaaaagtagaagaatcacctaaatctataggatataattattatgcatctgaaagtattgaaaatttatgtaaagaatttggtttagaaagtataaatactggtttaaattctgaacaagtaaaaataaatagagacaaatatggagaaaactttattgaaaaagatgaagtggtacctgtatggttaatatttttatcacaatattgtagtcctgttgttttgttattgttagttgctgctgtagctagtcttgcattaaatgaagttgttgaaggagtcgctattataagtatagttaccttgaatgcttgcttagcaacctatatggaaaaatcatcaggtgatgctataggcaaattagctgaaatggcttcaccacaatgtactgtgttaagaaatggtcagaaggtagttataccgtctcgagaagttgttgttggtgatgttgttcttattaatactggtgattctatttcagctgatttgagattatttgatgttattgaacttaaaacgaatgaaagtttattaacaggagaatcagaagatattaaaaaaaccattgtagcagataatttgtctacaccttttgcaacgaatttatgttttgctaccacatctgtaactagcggttctggtaaaggtattgttatatccacaggtttagatacacaagtaggaaaaattgcatcccaattaaaaaaaagcagtaaaggaagtaaattaacacctcttcaagtagcattaaataaattaggtggtttaattggtttaatagctattattgtattagttgttattatcagcttagctgttattattaaatatagagatccagcacatgcagataaagatccaacctttgttattattattattggtgtaggttttgctgtatcttccattccagaaggtttacctatggttgttactatcaccttatcagcaggagctaaagatatggttaaaaaaaatgcaaatgtaagaaaactaccagctgttgaaactttaggatgctgttcagtcatatgttctgataaaaccggtacattaactgaaggaaaaatgacagcaattaatgcagttaccatttgtaaaaattcttccttaagtgatgaaaataacaaattaacgaaaacatttgatttttatccaacaaaaggttttgaaccatgtggtggtttatttgattctaatgaattaactagcgaaaaaaagaaagagattgtgatagcaaagaatcaaaacacatcatatgataaagttttgtataattatggtaatccttcaaacaaatctgttattgtagacaaaacgaggtcattaatgtttgctgcttatttaaattcatatgatactacattatcaagagatcccaaaactttaaaatggggaatacatggtaatatgagtgaaggaccaattgttgttgctgctgctaaagtaggatatagttttattaataatccaaatcacaaatcttatttggataattttcaaagattagatgatttagaagttacatttaattcatcaagaaaaatgaaaatcactttttataaattaaaaacagtaaatgttttcgagaatgtatatttagataaacctggtaaagtatatacacatgttgctttgatcaaaggtgcacctgatagattacttgatagaagtacccatttattagaagaaacatctatgaaaaaagtacaagtttcatggaatagtacaataacacaagaagaaagaaatgtattaataaaaaagaatttggaattatcacaaaaagctttaagagttttatccatatgtattaagccactaacggatcaaaatattgaagaattgaaaaaattagaagatgcagatgaaagattaaaatatgttaattatgatgaaaatggtggttttatacctatgggttatgttgcatcatttgatcccccaagacctggagtaaaagaagctatacaaacatgtagagaagcacaagttaaagttattatgattacaggggatcaaaaacctactgcggttgctattggaaaattaataggtttgatagaagagaaatctgaacaa

SEQ ID NO: 426 - DNA, 645 bp, Plasmodium falciparum
ttcaatacaaatttaggtgtattatttctcttttatatgacatttctttttttctactttattcttataagttccaattgttcagaaaatatgatccaaatgaatgacataacatcgacatggataaatgaaaatatacataatagaaatgatcctataattacaaaaggaaatttggagaataaagaaaagtgtacttcatgtaatacatctataaaagaaaaattttattataaattaatgatagaaaaattcaaattattaaatacatgctctgtattaaatgaagaagaaataatgggaatacaaatttataaattaattagagatatttcttatttttatataaatgaaacagatttttatattttatcatgtgtacttttaatatattctttttttataacgggacataaatttattttaaataacttaccactagtttcaggttatgttggattgtataaatatgtgtggccaataagtcagttttatatttttaatcatattttttttccattcttcttttcgttattttttatcatttatatttataacataagaaggataaaaattataaattcttttaagcaatttgatttgtattatttttatgtttatccactaatgaacttttccttcaag

SEQ ID NO: 427 - DNA, 666 bp, Plasmodium falciparum
atgaagtatcccaacttttttattttaaaagttttttatttccttttcttttatttgagctttgaagatatttattaccattgtattaacataggaaaacctcaggttaacacaaatggaaaaaatgtcaactccaatgaaaaggctaataatttatctactgaatggagtaatagaggatttaattttatggatttattaaaaaatggatatttacagagtcatgggaatttagaagaagtgaaagatgaattagctaatgaattggctaataaaatacagaataaaattggtgaatatttgaaagatgaaaaaaatttgagtgttcttcaacatctccaacttgaagatttagacgatttaaaacattatgttaaggatgtgtcagaatatataggagcaaaagcaggtgatttattagatgaaaatttagaaagcactctcaagcctcttttagaaaggaaatcctttgagacatttgaacaagctttacataataaaagtacagataattttgtacctttcgaagaaaataacaaatccggaaatgctaatgaagaaacggaaaattttgtggatgaattagttgaggattatgaaaagacaaaaaatccagatttagatgaacagacaaaggatataaaaacacacagtgatagtgattaa

SEQ ID NO: 428 - DNA, 2364 bp, Plasmodium falciparum
atgaatatgtttgaaaataaaagaagcgaagatgaatctgttaaacttgatgatttaaaacatatttttgaaaatagttttgaacttcatttattaatagattataagaaaaaattagaagatttattggaaagtacagaaaaggtggattcatttttgaatgataagaatgttttgaatactatgaaaataaggaaaagaacattatcttttttgatggaaaacaaaaagtatatagataattttatacaaatgaatgaagaaaaagattacgcaaaaattaatgagtgtgaaaagaagaaagaagaagatattattcataatacaacatgtagaaaagtagaaaaactagaagataggattattcaaaatagccataataatcaattagcaaatcctgaatattgtagtacattaaaaggagaagaggataaatccgtaagtttgatagataataaatcaatgtgtgaaagggtagataatcatagtatttgtaatgaagtaaattcaagcatatcaagtacgtacgaaaaaacattgtacaataaatctaataatataattagaaatttaaaggaaatgaaaaagtatgaaagagaatgccaaaataataacagttatagtaatatgtattgtagctatatgatgaaattaagtaagaaaatattaggatttcctttaataaaagacttttctaaaggcttaagtacacttgaaccatctttacctttaaatgatcatttaaaaaaattatcggtttgttcaaattgttatagtaaacatcatgatttagcaaaagcaattatttgtagagtgacaaaaatgcattttgaagctaattataatgattacttaactgacgaagatttatttaaaacatccagtgaatttatccaatcagtcataagagaattagctaatactgtaaaagagtacaggaaaaaggaattgaatagggtatatttgcaacatgcaacagaaaatgatagtatgatactagatagagttaataaggatatgagcttggaattaaattataataatgttacaccaactagaactagtattcacaattgtagttgtacaaaaacgaataaggaatataatgaatccttttataaaattgtgagtccttcatttaataatgacactgttgaaaagagtaatattatcatacaagaaaataaccatattcgaaataatgaaattttacaattaggtgaagaagaagtgggaaattacgaatgtcagaataaagaagttattggttctgatacaaaagagcatacaaatgaaaggataaacgatcaaacaagtgaggaaaaatgtcatgatgatttctattcaaaggatatgcatatattatataaaaatacctttttaccaagagaagaaatagataactgtagtatagaaaaaattaatgatgttgaagagaaaaaaatgacacaccaacatgaagaaaatgacatattaaaggatgtaataaatgatacattaaatgatatgtcaaatgatgttccaaatgatatgtcaaatgatgttccaaatggtatgtcaaatgatgttccaaatggtatgtcaaatgatgttccaaatgatatatcaaatgatgttccaaatgatatatcaaatgatgtgtcaaatgatgttccaaatgatgtgtcaaatgatatatcaaatgatgtgtcaaataatgttccaaatgatgtgtcaaatgatgtgccaaatgatgtgccaaatgatgtgccaaatgatgtgccaaatgatgttcctaatgatacatcgatcactaatttgtatgaacaaaaaaatgatttgaacagctatgagaaatcttgtaaattaaataattttattccccttataggagtagaattaggaaagacgaaattccaaagagaatttacaaatggtacttttgttggtagagttacagaacaaataaaggacgaaaataataataatttttttgttgtaacttatgaagatggagatgttgaatggataactccatcctttttatttcaagaaattctaaaacaatctacaaataatactacatatcctttagctagtacttttaaagatatattttatgaagattttaaaaaggatataaaactaaacaaccattcttatgaattaaaaattgaaaagaaaaagcgaaaaagtatgtttgaatatgttcctaataataatgtaaccaaaagacaaaggcatgcattcgaagaaaatgtattaaaaaaaaaaaatacccatcaggaagttaatacatcacaaagaagtttgagtaaattgaaaaatgtagtatttaatgattcacttaaaaaaacaagaaaaagaactatgtctacaagttga

SEQ ID NO: 429 - DNA, 2466 bp, Plasmodium falciparum
atgaaattaaataacatatattctttttttttccttttttttgtgttatgtgtaatacaagaaaatgtaagaagggtcttatgtgatagtagtgttgagggtgataagggacctagtgatgatgtgtcagattctagtggggagaagaaggaagtaaaaagagatagggatacattagaagaaattgaagaaggagagaaaccaactgaatcgatggaaagccatcaatatcaaactgaagtaacaagattaatggatattatagttaattctttatatactcagaaagaagtatttttaagagaattaatatctaatgcagctgatgcattggagaagattagatttttatctttatctgatgaaagtgtattaggagaggaaaagaaattagaaatacgtatttcagcaaataaagaaaagaatattttatcaattacagatacaggtataggtatgacaaaagttgatttaataaataatttaggtactattgcaaaatctggtacttctaactttttagaagctatttctaaaagtggaggagatatgagtttaattggtcaatttggtgtaggtttttattctgcatttttagtagcagataaagtaatcgtatatacaaaaaataatgatgatgaacaatatatatgggaatcaacagcagatgctaaatttactatatataaagatccaagaggagctacattaaaaagaggtacacgtatatcattacatctaaaagaagatgcaacgaatttattaaatgataaaaaattaatggatttaatttctaaatatagtcaatttatacaattccctatatatttattacatgaaaatgtatatactgaagaggtattagcagatattgctaaagatatggtaaatgatccaaattatgatagtgtaaaagttgaagaaactgatgaccctaataaaaaaacaagaacagttgaaaagaaagtcaaaaaatggacacttatgaatgagcaaagacccatatggctaagatcaccaaaagaattaaaagatgaagattataaacaattttttagtgttttatcaggatataatgatcaacctttatatcatatacatttttttgcagaaggagaaattgaatttaagtgtttaatttatattccatctaaagcaccttctatgaatgatcaattgtattctaaacaaaattctctcaaattatatgttagaagagttttagttgcagatgaatttgttgaattcttacctagatatatgagttttgtgaaaggtgttgttgacagtgatgatttacctcttaatgtatccagagaacagttacaacagaataaaatattgaaggcagtttctaaacgtattgtacgtaaaattttagataccttccataaattatacaaagaaggtaagaaaaataaagaaaccctacgatctgaattagaaaatgaaactgatgaagagaaaaaaaaagaaattaccaaaaaattaagtgaaccaagcacatataaattaatatataaggaatatagaaaatttttaaagagtggttgttatgaagatgatattaatcgtaataaaattgcaaaattacttttattcaaaactatgcaatatccaaaaagtatatctttagatacatatattgaacatatgaaacctgatcaaaaatttatttattatgcttcaggagattcatatgaatatttagccaaaataccacaattacaaatctttaaaaaaaaaaatattgatgtacttttcttaacagaatctgttgatgaatcatgtatacaaagagtacaagaatacgaaggaaagaaatttaaatctattcaaaaaggagaaatctcttttgaattaacagaagaagaaaagaaaaaagaacaacaaatgcaaaaaatgtataaagcattaattgatgttatatcagatactctaaaaaatcaaatattcaaggtagaaatttctagaagattagtagatgcaccatgtgctgttgtatcaactgaatggggattatcaggacaaatggaaaaattaatgaaaatgaatgttagtaattctgatcaaattaaagcaatgagtggacaaaaaatacttgaaattaatccaaatcatccaattatgatcgatcttttaaaaagatctgtaactaaccctaaagatcttgaactaacgaatagtattaaaattatgtaccaatcagctaaattagcatcaggatttgatttagaagatactgcagatttggctcaaatagtttatgaccatattaatcaaaaattaggagttgataataatttaaaaattgacgatttagatccatctatatttgaaactaaaaaaattgaagatgaaaatgactcatccaaatttgaagaagaaattaatatagatgatgaaatacaaaagaaagataataatgtagataatgaatcaaatgataaaagtgacgaattataa

SEQ ID NO: 430 - DNA, 2472 bp, Plasmodium falciparum
gcaaataaatttaaaaatttaaatatggataatatgaatgcacctaatggagtaacaaacctcaatgtgggcataaacaatgaagtagtaaaagaagagaaaactaatacttgcctaaatataaatgagcaaatacattcccatacaaaattgaaatgtatcaaaaatgggaagcctagaaatattaatcagaaggaaaataatgtagtatatattgaatctgataattctcataatgacaataataataataataataacaacaataataataataacaacaacaacaacaacaacaataataataataataataacagttttgagaataatatgctgttgctatgtaagtccaaaaatgttaagaatcaaaatagaatgaacaatctatttcgtaaagaggaaaataaagataccaaattaaaatctcttaattacaatattttaataaatccttgttataataaaaataatgttattaatgaattatttatgaatacaaaagaaaaaagcttatatggtaacaccaacaagtttcataacacattgaataataatatgaatatgaacaattataataaccaaaatataaataatatttatccattgacgcataatatttccattgttaaccatatattgaatcattcctattacaatgaaaatacagaacaaaataataaaaacctttttcataatacaatattagtacctaaaaattgtaataatataatgaacaactctgataaatataattatttgaatgcatataaccaaaattataccttatacaataatacacttaataacaacaattctttagtacaaccatcagatgttaataatatgaattgttcatatgaatcgattaatggtaacatgccaataaatgatcaatcgtgtgatacatacaatgatgaatataatgatacatataatgatacatataatgatacatataatgatacatataatgatacacataatgatacacataatgatacacataatgatacatataatgatgaatataatgatacatataatgaaataaataatgaaacatacaatgatacattaaatgatacccctaatgatacactatatgatacattaaatggaattactaatgatacaccatatattacacctacaaatgcatgtaacctttcttatgaagaattaatgtacaaaatgcaaaataacaataatatatattgtaaaaagcatgatagtaattatattatatctaatgggataaataatcatatttgtgctcataaggaagtaaattataatgtattaaatcatgtcacaaatatcaatacttatgtaaatagtaaaaatatattttcaaatgttgctgttacaaacgatactgatttacatgcttgtaataatgaacaaagaaataatatatccaatcataatattaataaaaatgtcgttaatttaaacaacgttcattcaataaataaggaattaaataattatccaataaattcaacacaagattataatacgaattatgacaaaaacggttgtttgggaacattaacatgtgatataaaaaataaaaataataaaaataataaaaataacaaaaataataaaaataataaaaataataaaaataataaaaataaaaataataatgataataataataataataataacaacaataataatagtaataataataaggatattattatattaaataaaaacaatataaataacgctaacatttttaatataaattcattaaaagaaaaactattgaatgatgatatatctaaaaacaaagaaaagaaaaaaaagaaatgtgtcataagaaagattaaaaaaaggaacaaggttaacccaaaacggaataataatattaataatagaaataaaaataatggtagttataaatgtgataccaaaagagttaataaaattaacaatggtttcatgaaaaattttaaaaacaaatatacaagttcttgcattaattataatatgtgtgctattagtgatttatcaactaatataaaaaataaggaaaattttgttattggaaattatccatatactaatggtgtatcctatataacaaacggagaaaataatacaactaataatggtaaaaagaatgatgaccatagaaataaaaagaaagaatataatagtaacgaaaataataattactgcaacaataattctaatagaaataataataataataataataatagtcattttggtggtaataagaacaacagaggtgatgataatgatgaggatgatcaagaaaaaaataacaaaagaaatatttatggtaaaaatggagacgacgaagaagaagattatgatggggaggatgataataatgaagaaaatgatcataataataaaaagaatataaaaagaaaaaacaagaaatctaataaggcatataataataatgatgatgaaaacaaatgt

SEQ ID NO: 431 - DNA, 2229 bp, Plasmodium falciparum
atgagaagaaatttactgaagttaacctctataaattgtaagaagaatgactatgtttccctttctaacaatttttttttaataaaaaataggtcatataaatatataaccgtaagaaacaaaataggaagaaatgtatttaatgagaaggataattgtgccatattgaatcgaggacaaacacatgtcgtaggtatcaagaaaaatatatgtaccgaaaataaagttaaacaacaggatggagagttttatatgaatcaaagagttccagatgatatggataatgatatggataataatgtggataatgatatggataacaatgtggataatcatgtggataatcatgtggataatcatgtggataatcatgtggataatcatatggataatcatataaataatcatacacataaaaatgtgcatgatgacacatcatatgataataattctttcgatagataccaaagaaaaagagacgaaataggtgaaaacggttttgttcaaaatagaagatatgaaaattatgaaaaacgtaaacaatcaaaaacaaattattcatatgataatgattataatcagggttcaagaaataaaagaaatatgtcatatcctgatagatatgaagaattaggaagtcatttaaaggacatcgaatgggataatgtgaaatataaaatggaaaggcaaaatctatacaacaacaattataataagtgtaatgatcagaataataatcagaatagtaatgataatttaaataatgagcaaacaaattgtttaagtaaagaggatatacaaaacgaattaaagaaaaataatatttatattaacaaggatggaataatacataatatcattaataaattctcagatgtatgttttcatgaatccatattaaattatctaaataataaatttagtgaacctacagctattcaaaaaatcacatggcctattgctttatcaggaaaagatcttataggtgtagcagaaacgggaagtggaaaaacgttagcttttgttttgccgtgttttatgcatatacttaagcataaagaaattatacaaaataataataataataaacaaacaaatcaaaacaataatttacagcaagaacaggaagggaaaacaaataatcatcatataataaataattataatgaaaataatgacaacaatgaaaataatcacaacaacaacaacaataataataataataataataatagttatgattatgattatgatataaattcctctgaacgggcaagtgatacttatggactcattttattacccacgagagaattgtgcttacaagttttagatgaaatcaaatccttcgaaaaaaacctaccaattaaaagtgttgctgtttatggtggagtaccgaaatattatcaaataaataatttaaaaaaaggtgctgatattattgttgctaccccaggaagacttttagactttttagaaaatggtaacatcaaccttttaaaatgtatttatgttgttattgatgaagctgatcgtttacttgatatgggattcgaaaaacaattaagaaaaattatgacccaagttaataaaaataaacaattgctattcttaactgctacatggcctgaacaagtcaggaaacttgcatatgatttttgttcctatgatccagtaaaaattcaaataggaaaaaatgaattgacagcaaataaaaatattgagcaaaatgttattataagttcttctattgatatgaagaaaaaattattagattggttaaaagaaaattatgaaaataataaaatattaatattttgtgataccaaaagaaattgtgataatttatgtaaagaattaagatatcatcagtataatgctttatcaattcatggggataagcagcaaagagaaagagatcgaatattgaataattacaaaacagatcgatgtaatatattagtagcaaccgatgtagcttcaagaggattagatattaaaaatatttctgttgtcattaattatgatatacctaatactatagaagattatatacatagaataggaagaacaggaagagctgggaaaaaagggaaatcaatcttgttcttttcgtatgattattatatgccacaaaaattaaagtttgcaaaagagttaattaaattgttaaataaaacaaatcaaactgttccaccacagttaaaagaaatagcttattcaagatga

SEQ ID NO: 432 - DNA, 2232 bp, Plasmodium falciparum
atgatgaacatgaaaattgttttattcagtttattgctctttgtcataagatggaatattattagttgtaataaaaacgacaagaaccaaggtgttgatatgaatgttttgaataattatgaaaatttatttaaatttgttaaatgtgaatattgtaatgaacatacttatgttaaaggtaagaaagctccttcagatcctcaatgtgctgatataaaagaagaatgcaaagaattacttaaggaaaaacaatacacagattcagttacatatttaatggatggttttaaatcagcaaataattcagcaaataatggtaaaaaaaataacgctgaagaaatgaaaaatttagtaaatttcttacaatctcataagaaattaattaaagcattaaaaaagaatattgaaagtatacaaaataagaaacacttaatttataaaaacaaatcatataatccattattactttcttgtgttaaaaaaatgaatatgttaaaagaaaatgttgactatattcaaaaaaatcaaaacttatttaaagaattaatgaatcaaaaagctacctactcttttgttaataccaaaaaaaaaattatttctttaaaatcacaaggtcataaaaaagaaacctcacaaaatcaaaatgaaaataacgacaatcaaaaatatcaagaagttaatgatgaagatgatgtaaatgatgaagaagatacaaacgatgacgaagatactaacgatgaagaagatacaaacgatgacgaagatacaaatgatgacgaagatactaacgatgaagaagatactaacgacgaagaagatcatgaaaataataatgctacagcatacgaattaggtatcgtcccagttaacgatgtgttaaatgttaatatgaaaaatatgataacaggaaataattttatggatgttgttaaaaatacattagctcaatcaggtggattaggaagtaatgatttaataaatttcttaaatcaaggtaaagaaataggagaaaatttattaaacataacaaagatgaacttgggagataagaataatcttgaaagttttcctttagatgaattaaatatgttaaaagataatttaataaactatgaattcatattagataatttgaaaacaagtgttttaaataaattaaaagatttattattaagattattatacaaagcatatgtatcatataagaaaagaaaagctcaagaaaaaggattaccagaacctactgttactaatgaagaatatgttgaagaattaaagaaaggtattctagatatgggtatcaaattattatttagtaaagttaaaagcctattaaaaaaattaaaaaataaaatattccctaagaaaaaagaagataatcaagcagtagataccaaaagtatggaagaacccaaagttaaagcacaaccagctcttagaggtgttgaaccaacggaagattctaatattatgaacagtattaataatgttatggatgaaattgatttctttgaaaaagaattaatcgaaaataataatacacctaatgttgtaccaccaactcaatcaaaaaaaaaaaacaaaaatgaaactgtatctggtatggatgaaaattttgataatcatcctgaaaattattttaaagaagaatattattatgatgaaaatgatgatatggaagtaaaagttaaaaaaataggtgtcacattaaaaaaatttgaaccacttaaaaatggaaatgttagtgaaaccattaaattgattcatttaggaaataaagataaaaaacacattgaagctataaacaacgatattcaaattattaaacaagaattacaagctatttataatgaacttatgaattatacaaatggaaacaaaaatattcaacaaatatttcaacaaaatattctagaaaatgatgttcttaatcaagaaacggaggaagaaatggaaaaacaagttgaagcaatcaccaagcaaatagaagctgaagtggatgccctcgcaccaaaaaataaggaagaagaagaaaaagaaaaggaaaaagaagaaaaagaaaaagaagaaaaagaaaaagaaaaagaagaaaaagaaaaagaagaaaaagaaaaagaagaaaaagaaaaagaagaaaaagaagaagaaaaaaaagaaaaagaagaagaacaagaagaagaagaagaagaagaaatagtaccagaaaatttgacaactgaagaatcaaaataa

SEQ ID NO: 433 - DNA, 2148 bp, Plasmodium falciparum
atgatgagacggagaagcgtttacaatttcgatcaaggaaaacatggctatttaatgaatcatatatcttggcttaattttgtgagtttcaattggattacacaacttttaagatgtcttaagaatgatgattttgtattaccttgtatagaagaaacaagttccatagaacattatagcacgaacctaaataggaatgttcgaaatattcaattaagaaaatataataaatataataaatataagaattattgttgtagtaaatataatgatggtaataaaagttgtagttgctctacaaagaatcatacaaataaatttcataaaagaaaaaaggaagatcattttttaaaaagtagtggtattacatatgcagttttgaaaacatttaaatattatttaagtttaattagtttctttcatattatacataccatatttctaatatttgttgctgtgtgtattgagaaatatgtcttgttaatcaaaggcggttcaaatgttgtaactctaccatttggattcaaaaattctaaagtgttgttcggatttatagtcatttcagtaatattcattagtcagttttttgatgccctcctttgctattatgattttagattaagagtaaatatggaggtcaccgttatgtattttttatacaaaataacgttaggcaatttcaacaatcagttgattaatagaaacgatatatatgatgaccatagtgaagagggaaagggccaacataaaaatcaatgtcaatatgatgaaaatgatcagaatgatcagaatgagcaaagcgatttacgtgatatacgacatatgcatgataaacatgtcaaacataatgatgaagaaagcaaagattcaaccaacagtacgacatatatcaaaaataataacaatcaaatgagccacataaacgatttgtcaattacaaataatatgtccgatgtacatattttatcgagcataaaaaaccaagatcagaataacagtaataatgtttcgagcatggatagcaacaccaattacatgagcaaaacgacatgtttaacgtgtacaggctccgaatttaataaagaagaaaaagatgagaaaaaagaacttttagaagaagcgaaaaagaaagataaagaagtattcgatattagtatatataatataatgtttatagatacaccatttttaatttattttataacagcattaatagaattagcaaatatgataataaaatttataatgtcattttatatgttttattataaaatgggtagtgcagctgtattaaacggtgctttgttaattataataatgtatggattaatgtttgcttttgaattttcatccagtttatttaaattgaaatatttaaaatatcgtgatacaagaataagtaatatgcatcatatattaaaagaattcaaattaatgaaaatatttaattgggaatctatagcttttgattatgtaaatatgtttcgaataaaagaaatgaaaatatgtaaaatcagaacctatttaagttctttaagtaattatgttaataatatatctgtaaatattgtagaagttgctattttctttttttacataagaagtgaattaaagagtaataaaaccgtcagcttcagttctttaatcacacccctttttgtttataaatctttaatttctggtgtatctaattttccaaatataattaataatttaatagaaggtgctataaatattaagcgtattaataaatatataaactattatttgtttaacaatgatatgaatgattattttaagaattcattgaacggtatgaaaagtaatacgtgtaactttcaaaatggtaacaccaacaatgtgaatggttatgtggatgattatgtggatgattatgtggatgattatgtggatgattatgtgaatgattatgtgaatgattatgtggatgattatatggatcatatgatggagtataatataaatatcaatagtaaaaatggttgttcctccaaatcaagaaagaacaacaaatcattttcaaaagatcatttttcaaatcatgaacaagggacgatgcaaagtttttacaaatttttggatacacacaaaaataaaacaaaacaaaaaagcgattgtaaaaaaaaa

SEQ ID NO: 434 - DNA, 1023 bp, Plasmodium falciparum
atgagaatgaaaagaattcatattttgttgcttgtaatatttttgttatgtttgcggtatggatatagtattaagaagaagcgcagtcctaataacaagaataggctttttataaataagagattgaaatatataaatagtaagataataagtagaagaaaagaaaattatgtaaagatgaaaatgacagagaataaagtgaagggtaaagacataatatatggaaatgagtgtcgaaatgaattattaaaaggaatattaacagtatcagatgttgtgaaattaacattaggtccaagagggagaaatgtattattagaaaaagaatatggaagtccattaataataaatgatggagtaacaatagcaaaaaatatatctttaaaagatcgaaagaaaaataatggtgtaaaattaatgcaagaaagtacaaatatatcaaatgataaagcaggtgatggtacaagttcaacagcattaatgacagcaacaattaccaaaaaaggtattgaacaagttaatagaaatcacaaccctattcctatacaaagaggtatacaattagcctcaaaaatgattattgaaaaaattaaatctttatctacacctataaaaacatataaagatatacttaatatagcaaccatagcaagtaataatgatgtacatatgggacaaattattgctaatgcttatgataaattaggaaaaaatgcagccatcatattagatgataatgctgatattaatgacaaattagaatttactgaaggttataattttgatagaggaattattaatccatatcttttatataatgaaaataaggattatattgaatattctaatgtatccactttaataacagatcaaaatattgataatattcaatccattttaccaattcttgaaatattcgctaaaaataaacaaccattgtgtattatagctgatgattttagtaatgaagtcttgcagaccttgatcataaacaagttaaagggcgcaataaaagtggtacat

SEQ ID NO: 435 - DNA, 2733 bp, Plasmodium falciparum
catcctttatatatagatttatatatgagagatatatttgagtttttaaatttatttgatttaaaattattaaaaaatattctttttataaatatacaaatcttaacatttatatatgaaattaaatatggttattgggtaagaaatggtccacaaatgattttccaggttggtgaatatgataattctttattttttcaaaatgatttaataggaatacaatttgctataataatgatgaatgtcttacctttatacgaaaatcaaaaagtttatttagattcacatgtgatcaatctatttcatcaaatatggaatattaaggttcaatacgatgaaccacttaaaaaattaccatggtcaaaaaatgaatacaacgatgtgcaaaatgattatatacataaagctgatgatgaaatatgtataaatgaaaaggtatatgatgaggatactaataaatatatagatacatccccaaatttttcatataatcataatattcagaatcactatatggtagaagaacattctgaggataaaaaaccgtattatatgaataaaataaaatatataaaaaaaaatgatgaattttttgaagaacatatgaaaatgtatgagagcatgcttatatataatagatccaaaaaatcaaatgataataataccttacctgttaataataaaatgggaaattcaaaaggaaaaaatttggatcacgatgatggtgatcatgtcaaattgctttttggaattgacgacaaaaatgtaagcaataataataacacaaataatataaatagtataaatagtataaataatataaataatataaatgtgtgtaataataacaatacatatgtttataataaggtggaatttaaatctatatgtgatcttttgtgtaaatattcatgcaaacaattaaaagaccaagaaaatgaatcaaacccactgttaagagaaaccgaagggaggttaacctcggataatataaatttcaacaaattagataataataatgataatatacaaagtgatttgttagataatgataaaaggtattataataaaggatctgtaaggaaagaatcaatatataatgaagatagaatatgtgaaaaatataaaaagagcaaactagaatggaatgaatatttagaagaatttatgaatatagaaataagaaatccatttattatattatatcaattaatatttaagaattttcgtatgaatttaaatataagaaaaataaatgatatgtatgtagaaatcgaaatacatcatataaagatggcatataaaatatttagtgatatatatacaaataaatctactgtagattctaggaaaattggtcatatattttattttcaatttttttatgatataattatacgtatctttaatgaattatattatttagaatatagtaatataccaagaaaaacatcttatgaaaaatatatagaaagaggtaaatatcatgttaagaaaatattaatacaattattagcatcaaaagattttcaatattttcaactcgaaaatgtatttcctaagcaatttagacaccatccaagtttttatgaacttgttaataaatatggatataaaacacatatgcctagaagtaatgttaatttgataaagttaaataagaattcgtggtatctctatgatgccttttggcccctttcagcattcaaagattttcaaacagctaatgaaaaatgtataaaagaagaaaattcttcctatataggatgttcaagggaagaagacaaagaatatttaaatttttcatttcgcaaagtacaaaatttattattctatacatttaaaaatagttgtctcgtttctatacttttaattgtgtttattattaatgacgaatttcagaggaaaatcgaaaaaaaaaaaaaagaagaattagaaaaggaagaaatgaaaaagcatatgaaagcggatgtaacgggagaagacgactcgttgcttaatcaaaaaggtggtacaacgaataataatacgtgtgatgtaggagttgtcattaatgaggaagcaaaccgatccagtggaatgtcacaaaatgttgtgacttatgagagtggtataaatatgaataatgatgatgtattaggagaagaaaggaataataacgatgatattaattatatggatgataatgatgatgataatgatgataatgatgatgataatgatgataatgatgatgataatgatgatgataataatgatgataataatgataatgacaataatgatgatgacaataatgatgatgacaataatgatgatgacaataatgatgatgacaataatgatgatgacaataatgatgatgacaataatgatgatgacaataatgatgatgacaataatgatgatgacaataatgatgatgacaatgatgataatgatgaagattccaatcttcatggtagttcttctaatatgctaaatattataaacagcggtgataataattcagtaactaattctagtaatataaatacagcacgaaataataatagtacatatataattgtagatcagaatggagataatgaaaccttatttgcagagatattaataaatcgtaatcctaataattctataaatatggaaattgtaaatgtaacggataataatgttggtgatgaaaataataatagaaattatcgtcatttaaatgctgatggattatctgaa

SEQ ID NO: 436 - DNA, 1767 bp, Plasmodium falciparum
gatttttttagtgaagatcaaacgactgaccataataaacaaaacaatgaatatagtcatagtaatcatatagaaaatactttgaatgagttatatcacaaatcgcataaagaagatgaaaagaatcatgctcttcatgaaggaacatattcacagaataatttatttattggacataatgatcttcctcccttgagtaatatatataaattattaaaagatgaaataccaaataagcaatggttatattttttaaaaagttataaaaaacggattagtaaaaatatcatagtatgtacatgtgctatcgaaccaaaggaatataaaaaagaaaaagatttaaaaaatattttaaaacaaatatgtttagaagataatagtatcttgatatttactgataaaaataataaattagttattggttctataggaatattaaatatcgaagttattatagataaaataaagaatgattataatatagatatcaaaacgagtccagttgaaattattcagaaggaatatattcaaggatattatgaaaatagtataaaaaaggaaatgaaagttggttcatatatttcgactataatacttggatttgttataaaagaaaaagatgaatttatagatatttctagttatgtacaaaatgtattaaaacatgaaaaaatttcccactttttatcatcagaagaaggaataaaaaataatatatccaataataaatataataataataataaatataataataataataaatataataataataataaattaaatatttcagataacctggataaagataacaatttgttattatatgatgatatacgttttgaagataataaaaaaatgtatatatccaccacaaatgatgataggcaaaattatgatgaacaccataatattaacatattggataatatggaaataaaagaaagtacagaaaaggatagaaaaaaaaattatgtatataataatttaaagttaggtaattcaaaatctatgtatgataccaagggtgttaaaaattgggttcataagtataatgatgatcatgacaagatatacttggaggataatataaaggatcatcctcataagcaaagtattgatgatgaacctgaactactttgtgataatgatgataatgatgataatgataatgatgatgataatgatgatgttgatgaatatctcttaaactttaattatgataccctatttgaaaacagtgttactgtccataaagatgtattattatacattgacgagttaaaaaaaatgaataaaaaaaaaaaaaatgtctatgataatattttaaatagttgtattatatctttaaaaaactgtttaagtaatggatatcatactaatggaaatattattaataccgaaataataataaaaaacttaaaaatatttgatagttcaactactgctgtagctaaatatgcatgtaatcatttatattatgaaatgataaaaaaagcaaatatacaaatagttaatcctttatcattaattttaatacaaacagacgaagcatatactgggatcattgtaaaggatttaatacaatacagaaatgggactattatacaaataatgaaaaataaagaatcggattttaaacttatgaaaatatatgcaataattccagtgaaatttacacataattactcttccattttacgatctatatctagtggacatgctaactttcttatgactttttgtggttataaaaagtgttaa

SEQ ID NO: 437 - DNA, 2643 bp, Plasmodium falciparum
atgagttcgaagtatgacaatcagagttttctgtcaacaggatcagataaatatggtgaacaagaaaattctgttttattgcatgatgaggaagatgaatatataaatgagaataaaaagaagagaaatgaacgtgataagaaatttcgatattatgaaaatttttttaatagaaggagaagtaaaaagtggaattatttcataatattttttttaggtgtatgtttaggttttgccatatggccattttttatgactataataacgtatagattattttataaagataattttaataatacaaattatcgaacaaataattcttccacttctttgaaatcttatggaaatgagaaaaataagaagagtgataacaatggaaaagtacccatgaaagatcaatctccaaataaagtatctccacattttaaacctatacgatttgaagaaatagcaggaatagatgaatctaaattagaattattagaagtagttgattttataaaaaatagagaaaagtatcatgaaatgggtgctagaatgccaaagggtgttttattagttggacctccgggttcaggaaaaaccatgttagctagagctgtagcaactgaagctaatgttccatatatttatacttctggaccagaatttatagaaatatatgtaggtcaaggggctaaaagaatacggcagttatttgctcatgcaagatcagttgctccatccattgtatttattgatgaaattgatgcaattggtggaaagagaagttcaggatctgttaacggtgcaggtcaaagagaacatgatcaaacattaaatcaattgttagttgaaatggatggatttagtaatactgtacatattatggttataggtgcgacaaacagaattgataccttagacagtgctttattacgaccaggtagatttgataggatcgtttatgtaccattacccgatattaatggaagaaagaaaattttagaaatatatattaaaaaaattaagagtgatttaaaattagaagatattgaaaagatagcaagattaacacctgggttttctggtgcagatttagaaaatgttgtaaatgaggctactattttagctacaagaaataataaaagtttagttacaattaatgaattatatgaagccagagataaagtttctatgggcccagaaagaaaatcattaagacaatcagaccatcaaagaaggataacagcttatcatgaagctggtcatgctatcgttgcatattttcttcaacctaaaacagatccaatacataaggctacaattatttcaagaggtaatgctcttggatatgttgaacaaattccagttgatgatagacataattattttaagagtcaaatggaagcaaaattagctgtttgtatgggaggtagaacagctgaagaaattgtttttggtaaatcagaaactagtagtggtgcttcaagtgatatatctagagctaccgaaattgcttataaaatggtaacggaatggggtatgtctgataaattaggaccattaaattataaaaaaagaatgggagatggttattcgtccaatcgattatctgctcaaactgtttcatctatagaagtcgaagtaaagtccttagtagaaaaaggaaaaagcttatcagaagaaatattaagaagacatagaaaagaattagataatttagcttttgcattattagataaagaaaccttatccggagaagagatcaaaaatattattgatccaaataattccaaaaattattcaggtaaggtagaaatgttaaaaaatgatacaaagaaaaatgagaaaaagagtaacagtgtatctaaaaataaaagcaccatttctgaggattatgacaaaaatcaaaataatgtggaacaaaattaccaatcacatgatcataccttagttaaaaatgaagaaaatttgaataatatgaaaaatgatattgatgacaataatacgagagatggtcaagtaaattcagactcatttgtaaaaagaaaagaagtaacggatcaggatataaatggaaaagaattaagtgagatggataataaagagataaaagaaaataaaaagttagatggagaggaattaaataaaattattattgataacgataaaatgggtgatatgaaaaagaatataaaagaagttattaaaaaaatgaaaaaaaaacaatctaaaggttcttacaagacatataaaaatgtattgaaatctgtaagtgaacacaaggaattgaaaactcagaagaaagcggatgaaaataaaatcgtggctgataataatgagaagtcatctaataatagcttggataaaaataatacacaaggttcaatagatgaaaagggatataaaaataataataataataataataatatggtgaaaaatatcaatgaattgtttgaagagaattttcctgaatataagaaatatgataatgaaaataacgattttgtaaaaaccaaagaaaattactttgacaattttaatgaagtaatagatatatctcatataaaaaatgttgatgaaatgaaaaagtttaatatatttgaacataacttaaataaattatttttatttgacatatttaaaagcgactag

SEQ ID NO: 438 - DNA, 2931 bp, Plasmodium falciparum
actcttgaatatttagaagaagatattaaaattgtacaacatattataatgaaatatgtacaaaaattaaattctcttaaagatatcgaacaattaattgatgaattaaatgaaaacgaattaaaaacaaacgaatatttcacatttataaaagatatttttataagtattcatcagaattatatgaaagaagaattaaacagaaaagagcaaatgattataaatggacaaggattaattaaagaaaatgaagtaattcaattagaagaaaaattaaaagaattaacactagacaaaaatagatatgataaagatattaaaaatcagaaagatgaattacgtcatttaattgatagaaaggattcttatgaagacgaattaaatcatattataaacgaattagaaataaaaagagaagaaattaatcaaatgaataataaattgaatgaattaaaaaatattcaaaatgaaaataaacgtaaagttgaagatataaaaactaaagaaggagatttaaaatataaagaagaagaattaaaatatcgagaagagaatttaaaacataaagaagaagagttattaattaaaaatgaaaattatatgaataaagaaaaagaacttatgaaaagtaaagaagagttaattgttcgagaaaatgatttaataaaaaataaagaagatttaatagataaaacaaatgaattgatgttgaaaagagaagaattacagaaagataaaatacatattgatgaattaaaaaatgatttaatgttaaaatttgagaaattatataatgcacaaaatgatattaaagttaaagaaacgaaattgaaaaaaatttatgaaaaattaaaagatcataatataattgaattgtttgatataaataatagggataacaatagtaatataaaaaaccatacttcaaataatataaatagtgatataaaaaaccatactacaaataatataaataatattaacaatattaacaatattaacaatcggttatcattaaaaaggttgggaatacttttaggacttgatgaaataggagatgaaaatgaacttgattttcattttgataaagaaaatgaaagtttaaatttagattcccttgaatatacaacatattttaacgaattcaaaaagagaattaaaaatttaaaaaacaatttattaaacagagaaaaggatgttgaaatatacaaaaagtcttacgaaattgaaaagaaagaaaaagaaatttacaaaatcgaattagaaaaattaaatgaattattacacgtagaacaaatgaataggaaaaatctggatttagaattagagaaatataaaagtgaagatactcatattgtaaaatccttaagagaatctgaagaattattaaatgaaaaaaataataaaatattagaattacaacaaaaactaattgagacatcatatgaaataaatattatgatcgataaaaataaaaatttgataaaggaaaaagataaagattatgaacagaaaattgataatttgaattcaattattaatgattatgaaaaagaaataaaagaaatgaataaagaaaaattaaaacttaccagaaaatctattgaaaaaatgattgatgatggagaagatattaaaaaattgaaaatcgatttagatgaagcacaagaattaatattagatttaaaagaaaaaaatgaagaattaaataatataaatattgaattaataaattctaataaagatatgaggttagatattgatgtattactatcaaatgttgacaatttgaataaagaaaacatattaaatgaaaagaaaatgaatgaagatgaacaaaaatataatgaattaaaaattgcatatgatcaaaaagtacatgagtttaataaattatataatatgctttccataaaaatgaaaaacaaatttgattcagaaaatgatatggaacaaaattatacaaatgataatgttaatatgcaaaaatcaagaaatagtataaataataagtatgatattaatgattttgaaaatgatacgataattgccttaaacgaaaagaacatgataatcgaatctttgaatgaaaagattgcacattatgaagaagaaaattataaaaaagaagaactagttaataagtataaaaatatgataaacgaattatcaaacaagatacacatttttgaagacaatttagattttttaataagtttgaatgaatttataaaaacgaataattttacttatcaaaatatattagatatattaaataattcaattttatataaaaaactattaagtaaaatcttggttgaaaatcaattttataaatatattatatctatcagagattggttatttgaaattataaaatcaaaaagttatagtaatagtaataataataacaataacaatattattagtaataatagtaataccagagaatctgtattacgaatgagtttaaggaagaagggtaattttaaaagaacggcaagtgtaacatcgaatatttataatgatttgtttttaagcgaaaatgttttgtcagctgaaaaggagaatgatgaaataatgaatagttttaataaaaccttaaacgttattgacgatgattttaacagttttgaaaatatatgtattgaattaaataatttgtttatagaggaagattggaataatatatttataaaattaaacattttagaaaatcaatttaaaaatattataaatctaattatacatgaaatgaagaaaataaataagaaaataaaaaataataataatgaaaaattggaattaaagaagagtgtaaaaatattgaagaaaagattaaattcaatatctaatgatcttgaaaaacgtacagaagaaatagaacatttaaatattgccttaaacaaggaatgtgcagaaaaggatata

SEQ ID NO: 439 - DNA, 1716 bp, Plasmodium falciparum
aatattatacttttcttacttcataaatatatagattattatgataaacaaaaagatatttgtccattcattgtaaagactgatatacaagtaaaaaatgatattatggaagaaaacacacaaaacctcaaaacaaaaaataatgaacacatggaaaataaagaagacttaaataatatatctgatcatttacaaaatgtgaagaatttagatactagtacccattttgaaaaaagagaggacatggaacaacacgatgaaaaaatgtataataagaatgaagataaatcaaatggtatcttactatctgaccataacaataataataaggataataaaaaaagtaaaaagaatgacaaggttgatgaagaagaagatgatgatgaaaatattccatctgaattaaatgataaagacttagaaaaattaatagagaaaaatgtggaaattaaagatcttatgggtatatctagtccattaggaaataataatataaaaaagaaaaaagataataaaaaaaataatgataatgaaaataaagaaattaaacttgatttaaaaaaatcatgtttaacaaatgaggaaaagaaagaatattttattatttgtatttattcttttattatacaattatatgattatataaattgtacagataaagcattagaacttattgaaaaatgtataaaaagtattgaacaaaaaacaaataaaaatttaatatatgaattaatatttattaaaggattaatttataaacgtaatggtaattatttaggtgcatataaatattttgaacaatgtagaaatgttaatataggtgataggtatattaatacaaaaactatcaaaacatgtttaaaatgtggactaatcaaagatgcaaaaaaaatggcaagtatttttacaaatcctttagataataatttttttaaaaatataaatgaaacacaatgtttttggttagaatataatatatcattaagctatgttaataatcatccaaatatacatttaatacattatttaaaaacagaagcaaataatatatatgattttaaaaatgtatccccttgtgataatcaacataatgtgaaaaatataacaacgcaaaatggaaacattccacatcacaacgacaataataataataataataataatgatgatgatacaaataaaattgatgatatgcttaatgaaacaccgttcaatttaaaaaaaagtattttattagagaatgatattaattcaaaaaatatatttcaagattatagtaaaggattacatttattacatatgggacataaacaatttatagatatacatgaagatcaaatatgtttctattattatactatgagaaaaatgttatttaaaacatatagacatttattatatatgactggtcatcttttttcaagtcgattctatcgtagatttggaaaatctctaatcagaattttaatagatatgtatgattttaaaataaccggaaaagtagaaacaaataaaggaaataaaaagaaaaacaaaactaataataataataataataataataatgtattaaatcaggaagaaaatattttttatgaacatattcaaaatgaacctttagataatgctatgatatatatgaacacatttttatctcaaccaaatattgatatatcagtacacagattgaattatgaaatagaaaagaggaaaggt

SEQ ID NO: 440 - DNA, 2751 bp, Plasmodium falciparum
aaatttttatgtaaacatccttctgttaatttttatcctttggttatctctatatttaaaagaattttttcagaattacatacttctgatcatgtatatttaaaaaagaaatcatatgtacctaaccaattattattattattattattaaaaaattgtcaacagaaattacaaaaacgcacatccatctcttcacaatgtgaccatattaaaaatgatgccaatattgaaaatgaggaaaatattaaaaaggaaaatattaaaaaggataatattaaaaatgacaatgttaataataatgaccatattaaaaatgacaatgttaataataatgaccatattaaaaatgataatattaaaaatgacaatgttaataataatgaccatattaaaaatgataatattaaaaatgacagtgttaataataatgaccatattaaaaataataattattcttattattataatctgatggatacaaacattcatatatcaaacaacattaaccaaacaaatcatttatcaaatgtaattaaacaaaatgatctatatttttattataataactccaacattaatgatacacaaaatgtattaacacatcataaggatgaaaatgaagatacacttataaaatatattaatatatatcctaatgaatatatcaatccatatgatttaataaataacgaacaaggatatgatcaatatgaacaaaatgaacaaaatgaagaaaataaaaaaaatataatcgaacaacccatgttaggtggtcttaataaaaaatatcccgatataatgactggatatttttttgatttggattatattcaaaaattaatagaaatatatgcaggtactaatgcttcagtagatgtacaagaattaaatgaagatcaattaaatgctcagtgtggactcaaattaattaaagaagaaattatgatattacaagaaaattttaatttaaaaattaataatactgaatatgaatatatacaacaaattgaacaagaagaacaaaaattaaaaaatgcatgtattaaaaatgctatacatattttcttaaatccaaattatatttatttaatattttttattctctcaaaaattaaatatgaatatttatttgatagtaatacaaataatctaagaaatctatcggcgttggtagataaaatacatattgtcttgttacagtttgttgaattcttacaaagtaatattataccatctctctatttcaaatatatacctaatatattacacatctttcagttttttgatatctctcaatcattccatattgctagatacgccttccctttttttatgcaaacgaaacaaaacgaaaaacaagtgcacaacaaaaataaaaatgataataataaaaatgataataataaaaatgataataataaaaatgaaaataataaaaatgaaaataataaaaatgaaaataataaaaatgaaaataataaaaatgaaaataataaaaatgaaaataataataataataataaaaataataataataatgacacctctgtcgtgaagaaagatataacgtctacgattaaggcagttcatgcggatgcgtcccctgaggaagaaggaaatttaaacattttgaaagaaaccaaaccaaaaagtgataaccacgataatattaattgtgaaaatgttatcggcgaacgttcatgtaacacaacccatgatgaaatggttaagccacttaaaaaatacgacgatccaaattttcatcacgtaaacgaaattttgtggaaaatgttcctaatgcccatagtcgataaatatttaaaagaagaagaattgaacggtataaacatcaatttttatcttacatattggagattaagtatatcagatatttatgttccacataagcaatatcaaaaagtattagataaatatgaaaattatataaaaaaattagaaaaatattatgaagaaaataaaaaaaatgatgaatataaatggattcctaaacaaataaaaaaattaaatataaaaaaaaataatttaaaaaatgaatatgaatatcatataaatcatacaaaacaaattaaacaatatttagcacatattgttgatcattgggtagatccacaaaaggttagtttaaatacttttgtagcttttataaaatgtctaatagcacccagaattctaaatagtgaaaaagattcattattctgttccaaatttatacaaatattactagaactacatacgccattatttaatctatgtactttagtatatatatttactaaaatgttaatgccattaattaatgcatgtacagaaaaagaagcactaaacataggaatatttttcaatgatttcttttcatatatatacttattatgtgaagatattaaatattttcaaaatgtctcaaataaaaatccttgttttagttacactctcaattttcagtcaaaagatacaattactcataacaatattatacagaaagttatgaaatgggaaaaaactatcctctcattattatttgaaaataataattttgaaaaatcatggatcaattcaaaatcggttgttatcttcttatttagatttttaaatactttcccatattcacacaaaatcaaaaattctataaaaacatatcttgaaaacttacaaaattttgcaaataaccaaggttggaaagatattgtcatatcaattaatagtttgaagacaatgatggagaaaaacaga

SEQ ID NO: 441 - DNA, 2040 bp, Plasmodium falciparum
atggatttacatgtaaaaaagaataattatgatcaagttttaaatataaataaaaatcaaggaaattcgaattatgacctgatcgaaataaaaaataataccaacaataataataatagtaacaataataataataataacaaattaatagaacataaccattttaataatatagacgaacaaacaaaagaaaaacaaaatgtattttatgataatgatgtgagggaagtaaacacaaatgtaacctcaaatgtaaaagaaaataaaccatctaagaataatacggatactaatgtatatttatctattaatagatgtgtgaataatgagtgttcaaaaaaagaagattattacaaagatgtttataataatatatcacatatattagaccatggtttagctaacaaatcatgtgtaccaaaaggttgcttagaattagacaataaaaaagatgtttttaataaaatgataaacattaatagtaatatttgtaatacgaataataaagatatctataataaaataactaatgaacataattataaagatttaaatagtttaaatcatattaacgatgaagagaaaaaatcaaatataccaaatgaaaatatcttaagggaaaaatctgcacattgtgaagatgaaaaaaaaagtgaagcatggaattataaagaatccataaattataataaaaatcaatttgaaaaaaagaagaaaaaaagttttgaagaaaaaaaagaaagacaaaaagaattatttgttgcatattggttaaatggaattgttgatttattaaaacgtggatttaaaaatggtaatatatgtggaagtaattctgtagggaaaaaaattgctgaagtcttaaagaaaattgtagaaatatatcaatggaaaaatgtatttgatttaattgaaatcatcaaatatttaggaaaacaaattattaaaaataataaaatgttttttgtaataccaaatataataagacgagtattaaccataataagggttgagcattttaaacagttatatttatataataataattatatggataatatcaatatgtttgatgataaagtatgtgaagaaaatcgagggacacaaagccccaataattattgtcataataataataaaaacaattgtatcgataataatattttttatgataagaataaggtaaagaaaaaaaatacgatgcccataccaaaagaaggatcaaaaaatatagctaagtttgatataaacagtaatacattatatcaacgtgaaataaaaaactttcagaaatcattttcattttattttgaaaagccatgtaatgaaaatacttataaaataccagctacaaatacattaaaacattctataatagaaggcattgaagaactgatagcggaaatagatacatcttgggaagaagctgaacaaagaacatcatatgatttgtttacagaaaatgatgttatattaacacttgggtattcagcaggtgtggagaaatttttaaaaactataaataaaaagaaagatggaatatctgttatagtagtaggtggagatattaatagaaatggattcaggatgtctcaattattaagtgatgatggtgttgatacaacatatatatctgatgcagctgtttttgccgttatacctaaagtcacaaaagttgttctaggttctgttgctgtgtcttcatcaggtggaacaattacaaaaatgggtggttataatattgcatgctcagcacatttgtactccaaacctgtaattattgtattaccattattcaaattaatatatgttcctttatatgatccattaaaacaaaacgaattacaaccaggtccatcgcttatatataatgatgaggatgtagaaaatcttcatgtgaggataccaaaatatgattacataccagaacatctaataacattatatataacagaaatgggaccagtagattcttttcaattatacaacataacaaaaaagagatatcatccggatgatatggacttgagttttgactaa

SEQ ID NO: 442 - DNA, 1245 bp, Plasmodium falciparum
gccaaaagtgttgatgtagaaaaagaactcattttgaacagacataatttcaaactattacttaaaattttaaagattactaaaaagtccttattatatgaagagtcttatatgaagatatctgttgctaatttattaacaaaattttacaccttgattttagtaaatatagaacatataagtaaattaaatccaaaggaacatttctataatgatttagataatgaatttaaacatatatatcaagatcaaatgtttgaattatttatacaaaagatatcttcagatattgttagaaaaccatttatcaaaagaaatatcggaagaatagataaaggtagtatagaattaacattagcattaataaaagtaaaattattacattacaaaccaacattgaataatccatattccagtttatattttgatgagaatttaaaaaaacaattaaattatgcatttaaattaattattattggttctactagtataattgctagtcttgcaaactacggagaaagatatggtgttttaaaacaatgtccattagatattgttaagaatttaaatcaacaatgtgaatatgtttcttttgaaattaagaaattaatattcccaataaatatttttgtgaacttattaattccattatttttaccatatgatgatgtattagtagataaaaatataattgatgaagtcaaaaaattctttaacgttattatcgataccgatgattcttacttacaaaaatatatgaaaacaacaattaacactataagaaaatcaaaagatctagatataaataatgtaaattatgaagaagaaatggaaaaaattgtagttcaagaagcacataaagttattgaagaaattaacaaagaaagacgagcatctttcaaatttcaagattttgtagtcaaagaagattcagtagtattgtataataaaagtggaatccaatattcatttaaatttgatcatttaaatagaaaagaagattttatgcgtattataggtagttatcaatttaaaaatcccataggttatcaaacatcacaacttgtttttgaacctcaaaataatcatattggttctttaatggttggatcaaataaaaatacattcgatggaaaattaagtgtatgtcatatgtgttataaagaagatgatgattctttggttgttgatgcaatatttagtatcctctggtcttctggaattgatagatttagtgcctttata

SEQ ID NO: 443 - DNA, 2124 bp, Plasmodium falciparum
aatttcaataaaaaaaaaaatcaagatcataaagcacatggatcaaatgtattccttgatgggggtctttcattaagtaaaaatatgtcatttagtgatataaatgatttaagtgaatctattcaaaattatttatatttagaaaaatttttagctgatagtaatataccttctattccatatcaaggattttcggttagacgtgtaaatgatggtatgcatgtaacatataataatagatcaactacaccaccactttataaagataatgttttagatcaattcgaattagtaggaaaatcattaattagtgaatatttccaaaaagtcaaatgttcatttattcaatatccattcaatttatattattggctagtccttaatccaggaaaaccaaatataagcttaagtagtaaaaccggtctaattaaagaagatgatttaatacctaaaaccgttgaagaaaaattaaaggaagaagaagaacatgatattaaaattgttgaaaatatattatctgaagatatctttgattttaaagataaatcagatgatgatcaaagtacaaccgctgatgtactttctacagacacagatgattcagaaactgacgctgaaaaaacatcaaacaattcaaataccctacacaaaaaagaaacaccagcaatgaaatataatatgaatatagcacaagatgaaattaatagacaaaatgatgtatctaaaaatacaacatatgcagaaaataatgaatacacatctgaaaatataactaaaccatcagatcaaaatacagaaaactatggaacaaaaatgccctctccatcattcatacaaatagataaagttaaccaacaagatcaacaaaatgatgctcatatagaaagttctaaaaatactcaagaaaatcttaactatgatgataacactaatatgtatgaagaaaataaaaatgataagaaaaacaaaaaattaaataataatacaaaagaaataagtttccttgaaagaagagaaactaatcctataccatttagttcaaatatgattaatgaaaaaaataaagaagctcataaagaacactatggaaatttcaatagaccatataatatatatgtacctaaaaaagatatcttcagaaatttccatctagttgtaaaagtagtacatgcattaatatccttaaataaattctccatggttagtccagatacaatattaaaaaaaggtatagaatccatgaaaaaaaaacactcactcaaaatgattaaaaatataaatccatttatacataaaatgatacttgacatgaatgaaaccatacaaaaattaaaatccgatagtgaaaaagcatatggtggaccaaaagcagatattatatctttatataaaattgtggaattccaattatttaatcaatatattatatatccaccattaaaaagattaaccaaaaaagaacttaaatatatacttgatgttgttaaccaaggatattatttctacctaaaaaatgttatcacaaaattaaaaagagaaaatctacaaaaatcgaaagttgtcaaaatatttaataatttccaagaattctctaatttattagatgatgatggtgtagataaattatataatatatttactgaaacatttaaatgtaaaaatattaaatgttttgatcttttattccaaggattcttaaccgaacaatataataacattgtctatcgttatacacatgatcatgatgctatgaactcatataatgataacatatttaataataaagaattattaaacaaaatatttagaagagcatatgacaactattttattacacctgttaaaaacaatcaaccaaaaaaactcatatctttagaaaaaccatcattagaacaaccagtattgacgttagaagaatttgcatatggattccatgaatttggaaataaaattgaaaaatggagatcaatgcttaccctattcaatataagacatatatatattaatatatgccacatgctattaagtgttaaacatagtatacaacgatcacacagagtttttatgcacaaatttggtttcttcggtatcttcagaagaaagagggaaatttacataccataa

SEQ ID NO: 444 - DNA, 624 bp, Plasmodium falciparum
agaaaaaaaggcatattacaagagttattaaatactttaatagaagatataaaaacacgattgaagagtatattatatccaaacaatttagattcagaatataagaatataacatctaaaactaaaataacattagaggcagctgaaaagtgtttttcggaaaataagtggaaaataaaagattatgatatgggttctaccttagaaatgataagtgtaaaaaataatggatatgaaaaattatatatattagaaaaatctataaacaaattaaagaaattacttaatgatataaataataaatatcaaacaattaaaaaggctaaaataaaattagacggattagttgaaaataaatccgctgatagtactgaacagaaaaaaaatctaatgaatcttttacatattatagaaagtataaaagaaaatgataaaatacaaaatttagaacattattttatagatatcaataatataaatttagaaaccaatttgttaatagaaaatgtgcaaaattcattaaaccaattaatgaagttaaaggaagatgaaaagaaaaagaataccttaataaacgaaataaaatcaaagatggataatataaatgaaaagttaaaacatata

SEQ ID NO: 445 - DNA, 819 bp, Plasmodium falciparum
gagaattatctaaataaccattataatgtaagtcttattcaaaacaagaccaaaagagcaacgataaattcaagattattagcacaaacaaaaaatcataatccgcattatcataatgacccagaactcaaagaaataattgataaattgaacgaggaagcaataaaaaaataccagcaaactcatgatccatatgaacaattgaaagatgtagtagaaaaaaatggaacaaaatatacaggtggtaatgatgcagaacctaggtcaacgctggaaaaagaattattggaaacatatgaagaaatgtttggtgacgaatgtcatatgttgaagtcgggtaagtaccaaaatgttgatgaaaaatcttcaacatgtgaatgtactgatattaatggtgggaaattatcaaaaacaaaaggaagagataagtatttaaaaaaactaaaacacagatgtataggtgggatatgttcttgctcagtaggtagttttctcttaacaatgttcggtttgcatgctgctaaagctgctgcccttgctgagtttactaaatatggaacaacttatagtgcgtgcaaatcctctatcactatatatagtatgcttagtagtgattctatgattgcaggtagtacagcttgttttactgatttaacagtacctgctgcaacttctgctggtgcaatttttgatccttgtggtattacagctttagttctacttatattagctgttatacttataatattatatatatggttgtatagaagaagaaaaaattcatggaaacatgaatgcaagaaacatttatgtaagtaa

SEQ ID NO: 446 - DNA, 954 bp, Brucella melitensis
atgtataactatctcgattttgaaaaacccgtcgccgacctcgaaggccagattcttgagctgaaaaaactcgcgcaggaacagggcagcgtcgagatgggcgacgagattagccgcctcgagaaacgctcggccgatgcgctgaaggatatctaccgcaagctgacgccctggcagaaggcgcagatcgcccgccatccggaccgtccgcattgccttgaatatatcgaccggcttttcaccgaattcacgccgcttgccggcgaccgcaaattcgccaatgatgaagcccttcaggctggtttcggccgtttcaacggcacgcctgtcgccattatcgggcaggaaaagggttccgacaccaagacccgcctcaagcataatttcggctcggcccggccggaaggctatcgcaaggccgtccgcatcatggaaatggccgaccgcttccagcttccgcttatcaccttcgtggatacggcaggcgcctatccgggcgtcagcgccgaagagcgcggccaggcggaagccattgcccgctccaccgccgaatgcctcaagctgcgcgtgccggtgatctcgatcatcatcggcgaaggcggctccggcggcgccatcgctattgcggtggcaaaccgcgtctatatgctggaacattcgatctattcggtcatctcaccggaaggggcagcgtcgatcctgtggcatgattccacccgtgccaaggatgccgcctccaacatgcgcattaccgcgcaggatttgttcgatctcaagatcatcgacggcatcattcctgaaccgctcggtggtgcgcatcgcggcaaggaatccgtgatcgacgccacgggcgacatcattgccgcctcgctgcgctccatgaaggatatcgacggtgaaacgctgaaacaggaacgccgccagaagttcctggaaattggtcgcaacatctga

SEQ ID NO: 447 - DNA, 1047 bp, Brucella melitensis
gtggggcagggggttacttttagccttccgtcgaatgacgcggctgtatttgagacagggcaaacaaagaagctgtcagcaacaacaggaaatgacggaaccgcgaccgcaataattatccgaaatgccgcaggaggaggaacagttactgtaacctgtgtgctggatgccgatggtaaggtttcagatcaatgtgatgtgcattttgctgctgtctcggctgatattatttctttcagtgtttcagctactgacccgcttgggtattcaaataatggtaaggcagcgcgagtttttgctgaaataattcccagccccaataaccccgtaacaaactgtctcattaatttttctacatttggggttagtgggattataaataattatgtaaatataatcggtgagccaaacagtgtttcgtccggcccgtcacttatgcaattcgttcagattggaaacactaagacgactatcccagtcgatgtcagttacaaaggccctgaagagggaagtgtcggaattcaagccgcattggtaacaactactcaacccgacaaggcctttgcattgtcaaccccgaatgcgcgggttgatttcatcaatccagcgcctcctcctcctccgcctcctccatcaccatgtcctccgccaccatgtccgcctccgccaccatctcctccggtgaggccgtcttatactattcagattgacgccgtagtagacaacatacctatcccgacaggacgtggagatatcgcaagggttactgtgtttcaaaatggtcggccgctagcaggtgcattagtgcagtgtagcttggtatctctaagcggaaacaccagccttatgttcgctctagctgctaatgaaatagccaatctggtaagtccccctcagaatacctccgggcttacaaacatcacgatgcgaacaaacacttatgggtggttcgagataaccttcgcccagtggttccagcgaggtcaagccagattcactgcaagttccaacggagcacagaatagccgaaactttaattttacataa

SEQ ID NO: 448 - DNA, 996 bp, Brucella melitensis
atgaaagccattctcaaagtcccttgccgcaacgctctggccgttcttgcagcgtcggttgcgctggcaagtttttccgctcctttttctgcatcggctgtctttgcgcaagatgccgctccaggcactgaaaaggccgctgccacaacggcggcagcgtctgcggaaaaggacgatccgtccaaggttctggcgaccatcaacggcaaggacatcacggttggtgaggtcgatcaggctgctggcgatctcgacccgcagttcgctcgccttccggtcgagcagcgtcgccttgcagcccttgcagccctgatcgacatcaaggcgatggctggtgaagcggaaaaagacaagctcgaccagaccaaggaattcaaggaccgtatggaattcctgcgcgaacgcgcgctccataacgaatatttcaagaatgcgattgttgacaagatcagcgacgcggatgttcgcgcccgctacgacaaggaaatcgccgccatgccgccgcaggtggaagtgcgcgcgcgtcacattcttgtaaagaccaaggaagaagccgaagccatcatcaagaagcttgaaggcggcgccaagttcgaggaccttgccaaggcaagctcgaccgatggcacggcctccagcggaggtgatctcggctacttcagcgaaggccagatggtgcctgaatttgaaaaggcagcttttgcgctgaagcccggcgaatacaccaaggagccggttcagacccagttcggctatcatgtgatccagcttgaggaccgccgcaccaagcagccaccggcatatgaccaggtcaaggaccagatccgctccatcatcatgcgcgagcgctacatcgaaacggtgaagaagctgcgtgatggcttgaagatcgactataaggatcctgccatcgaaaaagccatgaaggatgcggccgctgcgcaggaagcctccggaaaggacgatgcgtcggaagacgacgccccgcaggagtag

SEQ ID NO: 449 - DNA, 534 bp, Brucella melitensis
atgggaatttcaaaagcaagtctgctcagcctcgcggcggctggcattgtcctggccgggtgccagagctcccggcttggtaatctcgataatgtttcgcctccgccgccgcctgcaccggtcaatgctgttccggcaggcacggtgcagaaaggcaatcttgattctcccacacaattccccaatgcgccctccacggatatgagcgcgcaatccggcacacaggtcgcaagcctgccgcctgcatccgcaccggacctgacgcccggcgccgtggctggcgtctggaacgcctcgcttggtggtcagagctgcaagatcgcgacgccgcagaccaaatatggccagggctatcgcgcaggcccgctgcgctgccccggtgaactggctaatcttgcctcctgggccgtcaatggcaagcaactcgtcctttacgatgcgaacggcggtacggttgcctcgctctattcttcaggacagggccgcttcgatggccagaccaccggcgggcaggccgtgacgctgtcgcgctga

SEQ ID NO: 450 - DNA, 1227 bp, Brucella melitensis
atggctaccgaaattcgcgttcccacgcttggggagtccgttaccgaggcaaccatcggaaagtggttcaagaaggctggtgaagccattgctgtcgatgagccgctggtggaactggaaaccgacaaggtgacggtcgaagtgcccgcaccggctgcgggtgttctggccgaaatcacggccaaagaaggcgatacggtcgaagtgggcgaactgctcggccagatttccagtgacggggcagcggttgccgccgcaccggcccagaagaaggaggaagccaagcctgcagccgccgctcctgctgctgcaccggtcgcatcggcttcgtcgggcccggccatgcagccggcgccggctgctgcgaagcttctggctgaaagcggtctttccgccgatcaggtcgaaggttccggcaagcgcggccaggtgctcaaaggtgacgttctcgaggccatcacgaaaggcgtttcggcggctcctgccgctccggttgccgcgcgtccggcctcctcggctgatgacgcatcgcgcgaagagcgtgtgaagatgacccgtctgcgccagaccattgcgcgccgcctgaaggatgcccagaacacggctgccatgctcaccaccttcaacgaggtggacatgtcggcagtcatggagctgcgtaacaagtataaggacgtctttgaaaagaagcatggcgtgaagcttggcttcatgggcttcttcaccaaggcagtgacgcatgcgctgaaggaaatcccggctgtcaacgccgagatcgacggcacggacatcgtctacaagaacttctgccatgtcggcatggctgtcggcaccgacaagggcctcgtcgttccggtcatccgcgatgccgaccagatgtcgattgcggaagtggaaaaggaactggcacgtctcgccagggctgcgcgtgacggctcgctttccatggccgatatgcagggcggcacctttaccatcaccaatggcggtgtttacggttcgctcatgtccacgccgatcctcaatgcgccgcagtcgggcattctcggtatgcacaagatccaggaacgcccgatggtcgtcggtggccagatcgtggtccgcccgatgatgtatctggcgctttcctacgatcaccgcatcgtggacggcaaggaagccgtgaccttcctcgtgcgtgtgaaggaaagcctggaagatccggaacgtctggttctcgatctctag

SEQ ID NO: 451 - DNA, 543 bp, Brucella melitensis
atgcatactgtgaaaaaacttctcaacgtgacagtcatgtcggcacttgccctgacggttttttcaaccgctgttcaggctgcctgtacgcagaaccgcgcaatctatcgcgaccgtgacgaggcctatacgctgacctttcgtcccgagcagccgaatgatctgaaaatgacgccggcgccgacgaacgagtttacgattacagccaatgacaagccgggtttcaagcttaacggcattgtgatctggccggaggaaggcgtggcgcgtccttatgctcttattacctataattgcaagggcgatggttccgagccggaagacctcgatgattgcagcatctggcagagcgttatctacgcattgaaggatggggccgaggctgaagtgctgcccaaggcagacgagcctgccgcacaggcggttctgtttcccgatctggtgacggcgcttgacggatatgattttggtgcagccaaacctgaaaagccgcttcaatgggaagtgttccggtttcagggatgcacacctgatgaagaatga

SEQ ID NO: 452 - DNA, 534 bp, Brucella melitensis
ttgaaaacggctatcgaccgtggcggttcgttcaaggccgagcttgatacctatgtctcggtggcgccgcaggatgcttccgtggaagggctgcgcgcctatgcggacaagggcgtgccgacaattgccgatctaaatgcatggttcggtgcggttgccaatcgcatcgtggccacggaaaacaagcttcccgccgatgccagcctatgggatcagttgctggcgagcgccagggggctggtcagcgtcaggcccgttgcgggcaatgtaagcggcaccggcgtcgggccgacgacggcgcgcatggaggcggcattacaggcaggcgatcttgaccgggccatcggcgaatgggagcaattgccagccgatgcgaaagcggtttccgaagaatttgccagccagatgaaggcgcgccgcgatgccgatgcgctggtgcagcgtcttgtggccgatagcctcaagccgaaagcgccggtgacgggtgcttccgataatacaaccggcgaggctccggcctcttccggtcagtaa

SEQ ID NO: 453 - DNA, 1578 bp, Brucella melitensis
gtgtcgatgctgcgtgtcctgttttatctcattcttgttgccgcactgggttttggttttgcctggcttgccgatcgcccgggcgaactcaatctcatcttcgcgggcaaccagtataatgtgtcgctgattaccgctgttgccggcattgtggcgattgtcgcggcggttctccttctgtggtggcttgtcaaaagccttgtccagtcgccctatacgctgcgcaggcatttgcgcacccgcaagcgtgaccggggctatcagtcgctttcgacgggcctgattgccgctggtgcaggcgatgccgatgccgcgcgccgcatgaccagacaggctggcaagctgctcagctccgatcaggaaccgctcatcaggcttcttgaagcccagacagccatgctggaagggcgtacggaagatgcccgcaagggctttgaggcgatgatcgaagacccggaaacccggcttctcggtttgcgcggactttatatcgaagcccagcgcgtcggcgcgcgtgaagccgcccgccattatgccgccgaggctgcccggcaggctccgcagcttgaatgggcttcctccgccgtcatggggcagctttgcgcggagggggattgggatggcgcattgaaactggtcgatgcgcgcaggcaggtgctggcccatggcaaggatgtggtgaaaaaggaacgcgctgcgctgctgacggcaaaagccatggcgacgctcgacacccatcatgcccatgccaaggcgattgcgctggaggcgaacaagcttgcccctgatctggtgcctgccgccgtggttgccgcgcgggcgctttttgccgatggggaaatacgcaagggatcgaagattctggaagcggcctggaagcgtttcccgcatcccgatattgcctccacctatatttatgcgcgttcgggcgataccgcgcaggaccgcctgaagcgcgcccgccatctggtttcgctgcgttccaacaatgcggaaggcagccttgcgctggcgcgtgcggcttatgaagccggtgaatattctgtggcgcgggacaatgccgaacaggtgctgcgcgctgcgccgcgtgaaagtgcctatctgctgcttgccgatatagaggaagccgaaaccggtgatcagggcaaggtgcggcaatggctggcgcaggccgtcaaggctccgcgcgatcccgcatggacggcagacggttatgtttgcgaacaatggtcgcccgtttcacccgtcacgggccgtctcaacagtttcgagtggaaagtcccggtcgtggagcttgcacccgccatcgaggtggaaaagccggaaatcaaggcgccgctgccggaggtaaaggctgtggcacccatttcggccccggaactggaaccggttcgcgaaactgccgcccctgttggcgcgcgcgatgtggtggaggccgaggtgattgtgcccgcggcggaacccgtcagtgcggatgagccggtgaaggccgggcctgcgcatatcgtggttgatgatccgggcatcgatgatgacggagccccgcaaaaggcgcaaagcagcctgcgccttttttag

SEQ ID NO: 454 - DNA, 405 bp, Brucella melitensis
atggcccttaagattcgtctcgcccgcgctggctccaagaagcgtccttactaccacgtcgtcgttgccgatgttcgcgctccgcgcgatggccgctttatcgaaaccgttggctcgtggaacccggttctgccgaaggacgccgaacgcgtgaagctcgatgccgagcgcatccagcattggattgcacagggcgcacagccgaccgaccgcgttctgcgcttcctcgatcaggctggcattgccaagcgtccgtcccgcaacaacccgaccaagggtgagccgggcaagaaggctcaggaacgtctggccctggccaagcaggctgaagaagaagccgctgcaaaggctgctgaagctgccgcagccgctgctgctccggctgaagaagctgccagcgaataa

SEQ ID NO: 455 - DNA, 624 bp, Brucella melitensis
atgaccgctcagacggttgccacttccttttctttccgccgcatttttatcgctctcggtttgaccgttctggttccgctgctttcagcctgcggtttcaacacgatcccgaccaatgaggaaaaggccaaggccgcgtggagcgaagtgcagaaccagtatcagcgccgcgccgatctggtacccaatctggtcgagaccgtgaagggctatgcagcgcatgaaaaggaaaccctgcaagccgtgatcgaggcgcgcgccaaggccacgcaggtgcagatcacgccggaaacgctgaacaatcctgcgcttttcaagcagtttcaggacaatcaggcaaacctcaccagtgcactgtcgcgcttgatggttgtcgtggaaaaatatcctgacttgaaggccaaccagaatttcctcgctctgcaatcgcagcttgagggtactgaaaaccgcattgcagtggctcgccgcgattatatcgaggcggtacgcacctataatacgtcactgcgaaccatgccgacgatgatctggacatggatctggtatcgcgatgcacagcccatgccgaccttcagcgccgatgcaggcagccaggccgcgcctaaggtcaacttcaactga

SEQ ID NO: 456 - DNA, 1131 bp, Brucella melitensis
ttgggagttccaacaatgagaaaaacacttttttcgggcgttgctcttgctgcagtcatcgccttcgggggctcggcttgggctgatgtactggtcggtatcggtattcctgtaaccggcccgaacgccgtttatggtgcacagatccagaaaggcgccgaggcggcaatcaaggaagtcaacgatgccggcggcatcaatggcgagaagattgccatcacaatcggcgatgacgtatccgatccgaagcagggtatttcggtggctaataaatttgccgccgatggcgtcaagttcgtgattggacacttcaactctggcgttaccattccggcttcgcaggtctatgccgaaaacggtattctcgaaatttcgcctggcgcgaccaatcctcaatatacggagcaggggctgtggaacacattccgcacctgcggccgtgatgatcagcagggcactgttgccggtcagtatatttttgaccacttcaaggatgcgaagatcgccgtcgttcacgacaagaccccttacggtcaggggcttgccgacgaaaccaagaagaagctgaatgaacttggcaccaaggaaaccctctatgaaggcgtgaacgttggtgaaaaggatttctcggcgctgatcgccaagctcaagcaggctggcgtgaacgtggtttattggggtggcctgcacccggaagccggtctcatcatccgtcagatggccgatcagggactaaaagcccagttcatttcgggtgacggtattgtgtcgaacgagctggcgtcaatcgccggtccggctgtcgaaggcacgctcaacaccttcggtcccgatccgcgcaacaacccggataatgccgaactggtgaagaaattccgcgacgccggttttgagccggaagcctatacgctctattcctatgcggcggttcagtcgctggctcaggccgcaaaggccgctggcagcaatgatccgcaggaagtcgccaaagccatgaaggaaaagggcccgttcaagaccgtgctcggcgatctgtcctatgatgaaaagggtgatccgaagcttccgggctatgtcatgtacaagtgggaaaagggtgcagacgggaagtataattacattcagcagtaa

SEQ ID NO: 457 - DNA, 1032 bp, Brucella melitensis
atggctcttgcccgcaaccgccgcacacagaggcatatcgattactggccgggttttgtcgatgcgctgacgacgctgcttctggcgatcatgtttctgctgactgttttcgtgctggcgcaattcctgctcagccgcgaggtcaacaacaaggatagcgtgcttgcgcgcctcaacagccagattcaggaactgacgcagcttctctcgctggagcgcagcaattcgcaggatatgcaggacactattgccaatcttcaggcctcgctttccaccgtcgaaagcgaacgctctcgcctgcaaagccttctgaacgaaggcagcggcgcgggtgccgcggctgaaaaacgcgctggcgaactggcgcagagccttgatgcggaaaagcaggtgagcgcccgtgcgctgaatcaggtggaactgctgaaccagcagatcgcagccctgcgccgccagattgccgcccttgaagatgcactcaatgcctcggaaagccgcgatcgggaatcgaacgccaagatcgccgatctcggccgccgcctgaatgtcgcccttgcccagcgtgtgcaggaactgaaccgctatcgctccgattttttcgggcgtctgcgtgaaatcctgtcggacaaggaaaatatccgcatcgtaggcgaccgtttcgtcttccagtcggaagtgctgttccccaccggctctgcggaaatcaatcccaaggggcaggtcgaaatgaagaagcttgcggacgcgatcattcagcttaatcgggaaatcccggacgacatcaactgggtgctgcgcgttgacgggcataccgataacgtgccgctggcaggcaccgggcgcttccgcgacaattgggagctttcgtcggcccgtgcaacggcggtggtgaaatttctgattgccaacggcgttccggccaaccggctcgtcgccgcaggctttggcgaataccagccgctcgacaccgccaacacagccgatgcccgcgccagaaaccgccgcatcgagctgaaactgacagaacgataa

SEQ ID NO: 458 - DNA, 507 bp, Brucella melitensis
atgcgccgtatccagtcgattgcacgtagcccgatcgctattgcgcttttcatgtcgctcgccgttgccggctgtgcgtcaaagaagaaccttccgaataatgccggtgatctgggtctcggtgcaggcgctgcaacgccgggctcctcgcaggacttcaccgttaatgtcggcgaccgcatcttcttcgatctcgattcgtcgctgatccgcgccgatgcgcagcagacgctttccaagcaggcccagtggttgcagcgttatccgcagtattcgatcacgatcgaaggccatgccgacgagcgcggcacgcgtgagtacaacctcgcccttggccagcgccgtgctgccgccacccgcgacttcctcgcttcgcgcggtgtgccgaccaaccgcatgcgcaccatttcctacggtaatgagcgcccggttgccgtctgcgatgccgacacatgctggtcgcagaaccgtcgcgccgtcaccgttctcaacggggccggacggtaa

SEQ ID NO: 459 - DNA, 807 bp, Brucella melitensis
atgggcggtgctcttgcagcagaaggcgctaaccccgccgagccggatcatttcccgatccaccatccgaagcaggaaagctggagctttgccggtccattcggcacctatgacaaggggcagcttcagcgcggtctcaaggtttataaggaagtctgctcggcctgccattcgatgaacctcgtggcattccgcacgctggaaggccttggttattcgccggaacaggtcaaggctctggcggcggaatatgaagtcgaagacggcccgaatgcggatggcgaaatgttcacccgcgccgcgcttccgacggatcatttcccggcgccatatcccaacgccaacgctgctgcagcggctaataatggagcggctccgccggatctctcccttatcgccaaggcgcgttcggtggagcgtggcttcccgcagttcattttcgacatattcacgcaatatgccgaaggcggaccggattatatccattcgcttttgaccggcttcgatgagcagccgcccgcaggcatgcagattgccgaaggtacgcactacaatccgtacttcatctcggcaaaggcgcttgccatggccaagccgcttagcgatgaacaggtcacctatgaagatggcacaccggaaacagtggatcagtatgcgcgtgacgtctcggctttcctgatgtgggccgctgagccgcatctggaagaccgcaagaagaccggcttccgggtcattgtcttcctggttctcttcgcggggcttgtttacattgccaagcgttcgatctggtcggatgtgaagcactaa

SEQ ID NO: 460 - DNA, 756 bp, Brucella melitensis
atgaaactgtcggcaagagcttcaatatttacattagcacttcttgtttcaacaaatgcttatgcatcatcggccatcgtcacatcgacggttaatctgcgcaccggccccggcacccaatatggaacaatcggtgcgataccgaacggcgtcggcattatggtggcgggctgcacccgcggctatggctggtgtcaggtctcctatggcggcatgaccggctgggcggcatcgcgctatatcgccattcaaaccggcaacggctacacgacgaacgacaatttcggatcgaccgccgcagcggtcggcataccgctcattgctggaatcgtcatcggctcggccatcgcaaacagcggccctgcctgggggcccggcccctatcgcggctggggtggcaggcccaacatctataatggctgcatcgggcgcaattgccagtcgaactggggaccgccgcgcccgcattggacggaccccccggctggcgcgacaatccgggttatcatcccaatttcggtcatggtttcggtcacggctttggtcatgggccccgcatgcgtctcggcggcaggcggtaaggcgcagcgcaaaaccgggcctcctgacagccttctgtcaggagcatcgccggattggaaaagggtgaaggggatttcgcttccacactcttttcatttgaacgctgaaattccatattgggagcatggcttcctcaaaagacaaacatatccgggattcgcgcaacaaggctga

SEQ ID NO: 461 - DNA, 399 bp, Brucella melitensis
atgactttgatgaatactgaaaacgagccgacagggatgctgaccatccgcgtttccgccatgccgaaggatgccaattcagcctatgatattttcggcggctgggtgatggcacagatggatatggctgctggaatccgttctgccgagcgcgccagggggcgcacggtgacagcagcggtgcgcgaaatggcattcgcccgaccagtgaagattggtgacacgctctgtgtttatacggatataacgcgggtgggccgtacgtccatcacgctccgggttgaagcgtgggcaaagcgctatctcagcgataagcgtgacctcgtcacgcatgctgaattcatcatggttgcgctggatgcggacggcaagcctaccccggcaccgcaggaagattag

SEQ ID NO: 462 - DNA, 753 bp, Brucella melitensis
atgaacactcgtgctagcaattttctcgcagcctcattttccacaatcatgctcgtcggcgctttcagcctgcccgctttcgcacaggagaatcagatgacgacgcagcccgcgcgcatcgccgtcaccggggaaggcatgatgacggcctcgcccgatatggccattctcaatctctcggtgctacgccaggcaaagaccgcgcgcgaagccatgaccgcgaataatgaagccatgacaaaagtgctcgatgccatgaagaaggccggcatcgaagatcgcgatctccagacaggcggcatcaatatccagccgatttatgtctatcctgacgacaagaacaacctgaaagagcctaccatcaccggctattctgtatccaccagtctcacggttcgcgtgcgcgaactggccaatgttggaaaaattttggatgaatccgtcacgctcggtgttaatcagggcggtgatttgaacctggtcaatgataatccctccgccgtgatcaacgaggcgcgcaagcgcgcagtggccaatgccattgccaaggcgaagacgcttgccgacgctgcaggcgtggggcttggccgtgtggtggaaatcagtgaactgagccgcccgcccatgccgatgccaattgcgcgcggacagttcagaaccatgctagcagccgcaccggacaattccgtgccgattgccgcaggcgaaaacagctataacgtatcggtcaatgtcgtttttgaaatcaagtaa

SEQ ID NO: 463 - DNA, 354 bp, Brucella melitensis
atgaaccgcaatttcctgtttttcgtctcagccatcgttctttttgccctcgcagcttgcgggaaggctgatgaggaaaaagctgccgcaccggcggatgggcaggccgcttcgcaacctgcgacgccggtcggaccgtctgcgggcgaaaaaggtccggatcttctgaagttcatgcgcgagaattccggtgtcatgacgccggaggaaaaagctgcggcaattgagcgtgcgcgcgccaatgcggaaacggcagccaaggcggtggggcagagtgtcgaacaggtgcaggccgccggtgaagcggcagccgttgccgcacaacgcttgctggaagagcgtcagccgcaataa

SEQ ID NO: 464 - DNA, 930 bp, Brucella melitensis
ttgcggagtgctaaaagcacatgctgcttcaaacgggaaagacgctaccagagggccggagaccgcatgacgagtttcaaattcacgggtgtgacgaaaaccgcgctgttgagtggcaccatagccgttcttatcccgctcgccggttgcgccagcaagaacgacgatatcgatctcaccaaatatgtcgagacgatcgatcctgccgacaaactttacaatgaaggcctggccaatctggatgcaggccgtcttgatgaggccgcgaagaagttcgccgctatcgatcgccagcatccctatacggaatgggcgcgcaaggcgcttgtgatggccgccttcaccaattaccgcaaaggcaattacgaagaagcgatctcgatggcgaagcgttataacacgctttacccgacctcgccggaatcggcctatgcttattacatcatcggcctttcctacttccgccagatcccggatgtgacgcgcgatcaggcggcaagccgccgcgccattgccgcgatgcaggaagtgatcgatcgtttcccgaattccgaatatacggatgacgccaagacgaaaatccgtgttgcccgcgaccagctcgccggcaaggaaatgcagattggccgctattaccttgagcgcaaggaatatctggcggcgatcaagcgtttccgcggcgtggttgaggaatattcaaacacccgtcaggtggaagaggcgctcgcccgtctggttgaagcctattatgcgcttggcctgacatcggaagcccagatggccgcttcggttctcggcaagaatttcccggacagccagtggtacaaggacagctacaagctcttgcagagcggcggtcttcagccgcgcgaaaatggcaattcgtggctggccaaggctggggcgctcatcaccggcggcagctcataa

SEQ ID NO: 465 - DNA, 1575 bp, Brucella melitensis
atggcaattgcaccaaaggcgggttttgctcgcacccttttcgcaaccgttgcactgggggcgatgagtgtcgcgggcactgtgtcgatgggaacgccgcccgcgctggctgcgcaaggtcccgcttcggtggccgatcttgccgaagggcttctggatgcagtcgtgaatatctccacatcgcagaccgtgaaggacgatggcgagggggacggcccggtgccgatgccgcaggtgccggaaggttcgcccttccaggaattcttcaaagacttcttcaatgacaaggatggcgcgcagggcgatgattcacgcaaggtgcagtcgctgggttcgggtttcatcatcgatgccgaaaagggttacatcgtcaccaacaatcacgtcatcgccgatgccgacgagattgaggtgaatttcaacgatggttccaagctcaaggcggagctcgttggcaaggatacgaagaccgatcttgcgatcctgaaagtcgacccttccaagcataagctcaaggcggtgcatttcggcaattcggaaaaggcgcgcattggcgattgggttctggcgatcggcaatccgttcggccttggcggtactgtcacggcaggcatcatttcagcacgcaagcgcgatatcaattccggcccctatgacgatttcattcagacggatgccgcgatcaatcgcggcaattccggcgggccgctgtttgatatggacggcaaggtgatcggcatcaatacggcgatcatttcgccttctggcgggtcgatcggcattggttttgctattccggcggaaatggccgccggtgtcatcgatcagttgaaggaatttggcgaagtgcgccgcggctggcttggcgtccgtcttcagccggtgacggaagacattgcccagagccttgggctgaaagagaccaagggcgcgctgattgccggtctcatcgaaaattccggtgtcgataacaaggcgatagaggcgggcgatgtggtgatccgctttgacggcaaaccggtggatacggcgcgcgatcttccgcgcctcgtggcggaaagaccggttggcaaggaagtggaaatcgtcgttatccgtcagggcgcggaaaagaccctgaaggtcaagcttggctgtctggtcgaggacgacaagagcacggagccggcggttgaagatcaggtgcccgcgccggatgacggcgaacagccgggagcccggcaggagacgccggacaagtcggacaagccgaagaaggaacacaagagcgatgctgctccaagcgttctcggcatgaagctcagcaagctcgatgatgatattcgcggcgagtttggcattgccgaagatgtggagggcgttgccatcctctatgttgcaccggggacggctgccggcgaaaagcgcatcgaaacgggcgatgtcattgtcgatatcggtcaggtgacggtgaagacgccggaagatgtgaaaaagcgtatcgatgcactgcgccgcgaggggcgcaagaatgcgcttttgatgctggcttcgcgttccggggagttgcgtttcgtgacgatccgtatcgactga

SEQ ID NO: 466 - DNA, 570 bp, Brucella melitensis
atggccgaggcgcatcggctgaatctctttgcaacggtcgaaggcggcaccgttcatggctatgggtttttcgtcggcggaggccgtcccagcgaagcacaacttatcatccgcaatgcccagggcgtcgagcttttcaagggacctgccggcgaggatggcagtttcagcttcacgcccgcagcacctgccgatctggttttgaccctcaacgcaggcgacggccatgtggccgaagcccatatcgccgccgaccggttctcccaatatggcgcacaaggcgcggccagttccaccaaggcagaaacgggcaccgccacccccaagggggctgccttgcccgcatcgccctcaccggaagaactgagcgccatgatcgaccaaagcgtggatcgcgccgtttcgcgtcagatcgcaccgctattggaggcttatgccgaggccgatggccgtgcccgcttttccgacatcgtgagcggcattgccgtcatcatcggtcttgcggggctttttctctgggccaaatcgcggggacgcgccagccattcagaccggcagcgtgagccatga

SEQ ID NO: 467 - DNA, 375 bp, Brucella melitensis
atggctgatctcgcaaagatcgttgaagacctttcggccctgaccgttctggaagccgctgagctgtccaagcttctcgaagagaagtggggcgtttcggctgctgctccggtcgctgttgctgctgccggtggcgctgcccctgctgctgccgcagaagaaaagaccgaattcgacgtcgttctcgctgacggcggcgctaacaagatcaacgtgatcaaggaagtgcgcgcactcaccggtctcggcctcaaggaagccaaggacctggtcgaaggcgctccgaaggctgtcaaggaaggcgcctcgaaggacgaagctgagaagatcaaggcacagctcgaagctgctggcgccaaggttgaactcaagtaa

SEQ ID NO: 468 - DNA, 699 bp, Brucella melitensis
atgcgcgcggaatcgcaaattgaggataaccatttcatgctgaagaaaaccggtattgccctgatctgtgccacatttctggcagggtgcaccacggacccatatacgggccagcaaaaagtatccaatacgacgggcggcgcggccatcggcgcggctgtcggtgccttgggaggcctcatggtgggcggttccagccgcgcacaacgcaatgccgtgctgattggtgccggtattggcgctcttggcggtggtctcatcggtaactacatggaccgccaggaggctgaattgcgcgcgcaattgcagggcacgggcgtttccgttacccgtaacggcgacagaattatcctgaacatgccgtcgaacattactttcgatacggatcaggatcaggtcaagagccagttctacccgacgctcaactcggtggctatcgtcctgcgcaagttcgacaagacgctcgtggatgtttacggcttcaccgattcaaccggaagcgccagctacaaccaggccctgtcgcagcgtcgcgccgcttcggtggcaagttatctcgattcgcagggcatcgacccccgccgctttgccgttatcggttatggtgcaagccagcctattgccagcaacgcgacgccggaaggccgtgcacagaaccgccgcgtggaaattcagatttcgccgctacgcggagcctga

SEQ ID NO: 469 - DNA, 2658 bp, Brucella melitensis
atggctggcgtcaacgagattaggtccacatttctcgactattttcgcaagaacgggcatgaggtcgttccatcaagcccgctcgttccgcgcaacgatccgacgttgatgttcaccaatgcgggcatggtgcagttcaagaatgttttcacgggccttgaacatcgctcctataaccgcgcgaccacatcgcagaaatgcgtgcgcgccggcggcaagcacaacgacctggacaatgtcggttataccgcgcgccatcatactttctttgagatgctcggcaatttttcgttcggcgactatttcaaggaagatgcgatcagctttgcctggaacctgatcaccagggaattcggccttccaaaggacaagcttctcgtcaccgtctaccacacggatgatgatgcggcgaacttctggaagaagatcgccggcctttccgacgaccgtatcatccgcatcccgaccagcgataatttctgggcgatgggcgatacgggaccgtgcggaccatgttctgaaatcttctatgaccacggcgatcatatctggggcggacctcccggatcaccggaggaagacggtgatcgtttcatcgagatctggaacctcgttttcatgcagttcgagcagcagacgcctgaactgcgcatcgatctgccgcgcccatccattgatacgggcatggggcttgagcgtattgcggctgtcttgcagggcgtgcacgataattatgacatcgatctcttcaaggcgctgatccgtgcttcggaagaagcaaccggcgtcaaggctgaaggcgatttccgtgcaagccatcgtgtgattgccgaccatctgcgtgcttcgagcttcctgattgccgatggcgttctgccatccaacgaaggccgcggttatgtgctgcgccgcatcatgcgccgcgccatgcgccacgcccaattgctgggtgcaaaagagccattgatgtggcgcctgttgccagctctcatccgcgaaatgggacaggcctatcccgagctgatccgcgccgaatccctgatttccgaaacgctgaagctggaggaaacccgtttccgcaagacgctggaacgcggccttggccttctgtccgacgcttcggaaaatctcgccgaaggcgaccgcctcgatggcgagactgcgttcaagctttacgacacctatggttttccgcttgatctgacgcaggatgcgctgcgccagcgcggcattgccgtcgatacggaaggcttcaatgtcgccatggaacgccagaaggccgaagcgcgcgccaattggactggttctggcgaagctgcgaccgagacgatctggttcggcatcaaggataaggtcggtgcgaccgagtttctgggctatgaaaccgaaagcgctgaaggtgtgatcgcatcgctcgtacgtgatggcgtggaagtgccgtctgttcgggagggcgaaaccatatcggtggtggtcaatcagacgccgttctatggcgaatccggtggccagcagggcgatacgggcacaatttccggcgaaggttttgtgattgccgtcaaggatacccagaagaagggcgagggcgtcttcgttcatatcggcgaagtcaccgaaggaacggcaaaggctggcgatgttgtggaactgaaggtcgattcggcccgccgcacacgcattcgctccaaccattcggcgacgcatcttctgcacgaagctctgcgcgaaacactcggaacccatgtggcgcagaagggctcgctcgttgcgcccgatcgcctgcgtttcgacttttcgcacccgaagcccatttcggctgaagagctggaggctgtggaaaatctcgcaaacgagatcatcctgcaaaatgcgccggtcacaactcgcctgatggctgtggacgatgcaattgccgaaggcgcgatggcgcttttcggtgagaaatatggtgacgaagtgcgtgtcgtttccatgggtacggccaagcatggatcgaaagcgggcaaggcctattcggtggagctttgcggcggcacccatgtgcgccagaccggcgatatcggcctcgtccgtattatatcggaaggcggggttgccgcaggcgtacgccgtctggaagcgttgacgggggaggctgcccgcctttacctcgaagaacaggatgagcgcgtaaaggctattgccagtgctctcaagacgacatccgcggatgtgctggaccgcgtcaatgcgcttatcgatgagcgcaagaagctcgaacgtgaattggccgatgcgcgcaagaagctggcgcttggcggcggttcgtccgatggtggcagtgctgtcgaggcggtcaatggcgtcaatttcctcggcaagatcgtgacaggcgtttcgccgcgcgatctgaagccgcttgccgatgaaggcaagaagcaggtcggttccggtgttgtgttgttcattggcgtgggtgaagatggcaaggccagcgccgttgccgcagtcacagaggatatggtaggccgcttcagcgcggtggatctggttcgcgcagcttcggcggcccttggcggcgccggcggtggcggacgccccgatatggctcaggccggtggtcccgacggcgccaaagctgccgatgcaatcgcggcggtcaaagcgttgatcgcctga

SEQ ID NO: 470 - DNA, 795 bp, Brucella melitensis
ttgttttacggattttccaagattttctggctgtttttccagccccttacgattatttttcttctggtggcaattggtcttcttgccgcctggcgtggttttcggcggctaggtatcgcggtgctcatacccgcgacggcgctcctctttttcggcgccttcaccaccggtggcgcaatgctgctgtcgcctctggagaaccgttttcccaaatccgaaagcctgccacaacatgtggatggcattatcgtgctgggcggctacatgaacggggaaattgttgccgggcggcagaatttcgagcttaacagtgctgctgaccgcatcgtcgagaccatgcggcttgcccggctttatcccgatgcgaagatcctcgtttccggcggtgaagggactttttttgaaaaatcggcgcgggaggcggagactacccgcgcgcttctgttggatcttggtttttccggcaatcgctacatttttgaaggcaaatcacgcaatacggtggaaaatgcgattttctcgcaggctctggcgcagcccaagccgggcgaaacatggcttctggtgacctcggcctatcatatgccgcgtgcggttggctgtttccgcaaggcggggttcgacgtgacggcctggccggtcgattacaaaacccgcacgcgggagacgtttggcctttatctcgaatctcccaatgacgcgctttcgcggttcagcatggctttgcgggaatggacggggcttgccgcatattggtggacaggccgcacagatatgcttctgcctcattcctga

SEQ ID NO: 471 - DNA, 1419 bp, Brucella melitensis
gtgcgtaccgcattcagtaaagtcgcatatgccttgaaaaaagcggcacaggtctctcttcttctaacagccgtgacgggttactccacggtttcctccattgcaccggccatggcgaaaggcgacaacagatatgccgcgatcgtcgttgatgcgaacaccggcaagacgcttttctcggcaaatgccgatgcacagcgctatccggcgtcgctgaccaagatgatgacgctctatatgctatttgaagccatccacgccggccgcatcaacaaggatacgcgcattcccgtgtcggcctatgccgcctcccgtccgcccacgaagatcggctttcgtcccggccagtcgattcgggcggaagatgcggcccttgcgatgattacgaaatccgcaaacgacgttgctgcggcagtcggtgaatatcttggcggctcggaagaacgtttcgcccagatgatgaccgcaagggcgcgccgccttggtatgcgcaacacgaccttccgcaatgcgtccggcctgccgaacatggcccagcattcgtccgcccgcgacatggccatccttggcatggcgctgcgtcgccatttcccgcgtgaatttgcctatttctcgcgcagcagcttcgatttccgcggccaaaccatccgtggccataaccggcttcttggccgtgtcgaaggcgtggacggcatcaagacgggctataccaacgcttccggttacaaccttgtttcgtcagtcaatctcgatggtcgccgtctcgtcgccgtcgtgatgggcggcaataccggcgcaagccgcgatgcccacatggcccagcttattcgcaaatatctgccgatggccgcccgtggccgtaataacgatgctttgattgccgcgcgcagtgaagccccgcaggttgtggcttccatcgacctgccaaaaaccaaacgtgcaccggtgcccgtcgcccgcatcgccgtcgaggacatcatcaatgccgaaatcggtgaaggtgatatcgaccagccgcaggttctggccctcgtagcccccaccccgcgcccggcggctctggccgctcaggcagccgtacttccgacgccgaaggcccccgttcggccaacgcaggccccggcacaagatgtggatccggtgacaacggcatccgcatcggctgcaagcggctgggcgatccagatcggctcgctcccgagcgaaggacaggcccgcgatatgctggccaaggcgtccgccactgctggccgcacactgcgctccgcttcgccctatacggaaaccttcaacaagggtagcgccaccttctatcgcgcccgtttcgtcggctttacctccaagcaggcggcctgggatgcttgcgcctcgctgaagcgcaataacttcggctgctatgcggtagcgaactcgaactga

SEQ ID NO: 472 - DNA, 795 bp, Brucella melitensis
atgtgggccggatttgcgggtgcggccagtgcggcgtcagcggtcaggttggttccccatcgcgcaatctatgatctgaccctggatcgtgccgatgaaaaatcgggaatcagtggcctgaccggccgtatggtctatgaattcaacggttctgcatgtgaaggctataccaccaatttccgctttgtgacgcgggtcgacatggacgaacagccgcagcgcgtcaccgaccagcaaaccacgaccttcgaggatgcggacggaaaggactttcgtttcgtcaacaagacctttgtagacaaggaactggtcaaggaagtgcgtggcgatgccaagcttgaggatggcaagaccgtcgtcaagttgagcaagccgaaggaaaatacgctcgatctgaagggaacgcagtttccgacccggcatatggaagagctgatcggcaaggctgaagcaggccagaaattctatcagacgacgcttttcgacgcctcggaagatgccgaccgggtggttgccaccaccgtcgtcgtgggcaagcagcaggctgtgccggatgatgagaccaaggttatgggcaagttttcaaaggatcaggtctggcccgtcacgattgcttacttcgatgacaaggaacagcaggacggaatgccgatctatcgcatcaatttcaaactctaccgcaatggcattacccgtgatctgaccatggattatggagatttctccatgcgcggaaagcttgtgaagcttgatatctatgacacaggaaaaaataagactggatgcagtaaatag

SEQ ID NO: 473 - DNA, 390 bp, Brucella melitensis
gtgcttatccagcgttcagagggcggtggtcttggcattggcggcggttcgggtttcatgacggcacgcggcgcagccaatgcgctcacacgcacgaccgccattctggcgatcggtttctttgccacatcgctgctgcttggcataatggcgcgctacggcgagcgtccgacggatattctcaatcgtattccggccacaaccggcagccagagcgcaccggcaggtggcagcacaaatggcggtggcattctcgaccagcttggtggcgagccttccggctccggcaatggggcagcgcccgctgctccggctgcgccggcccagcccgatgccggacagccgcaggctccggcagccccggcaaatccggttcccagctcgcaataa

SEQ ID NO: 474 - DNA, 648 bp, Brucella melitensis
atgggagccgctgctcctgcctttgttgcttcgccggtcaatgctgaagcgcagctcgatgaagctgcggcaaatgtccagaaggtcgctctggcgagcaacgccaaggcaaacccggacaagccgaagaagaaaacggctgccaggaccaacaatacggccaaggccaacaaatatagcatcgatccgaagtttcgtccgcaggacgtgaccttcaccggctacaagcccggcacaatcgtgatcgatcccaagaagcgcttcctctatctggtggaaacttccacgaccgcgcgccgctatggcattgccgttggcaagcagggactggaatttcagggcaaggccaccatcagcgccaagcgcgaatggccgcgctggattcccaccaaggaaatgattgagcgcgatccggcccattatggccgcttcaagaacggcatggatggtggcccgggcaatccgctcggctcgcgtgcgatgtatctcttccagggcaacaaagacacctatatccgcatccacggtacggtgcagccatggaccatcggcagctctgcctccaatggctgcttccgcatgatcaacgaagacgtgatggatctctacgaccgcgttacgcttggtacggaagtggttgttctgtaa

SEQ ID NO: 475 - DNA, 1041 bp, Brucella melitensis
atggcaccgagggctaaaaaggcgcctgctggcaaaacgcaggcgtcttccgtgaatgcacccaaggcaccttcgcctgcgaatttcgacaagaagcaggagttggaagcttatcgcgaaatgctgctgatccggcgttttgaagaaaaggccggccaactttatggcatgggttttattggcggcttctgccacctttatatcggccaggaggccgtggtggttggcatgcagatggcgttgcaggaaggcgatcaggttatcaccggctatcgcgaccatggtcatatgctggccgtgggcatgagtgcgcgtggcgtgatggccgaactgaccggacgccgcggcggcctttccaagggcaagggcggctccatgcacatgttctccaaggaaaagaatttttatggtggccatggcattgtcggcgcgcaggtttcgctcggtacggggttggccttcgccaatcactatcgtgagaataaatccgtttcgctgacctatttcggcgatggtgcggcgaatcagggtcaggtttatgaaagcttcaacatggcctcgctgtggaagcttccggtgatctacgtcatcgaaaacaaccgttatgcgatggggacggcggtttcgcgttcttccgctgaaaccgatttttccaagcgcggcctttccttcaatatccccggcattcaggtcgatggcatggatgtgcgcgcggtaaaggcggcagccgatcttgcgaccgaatgggcgcgttccggcagggggccgatcattctggaaatgcttacctaccgctatcgcggccactccatgtccgatccggccaagtaccgctcgaaggaagaagtgcagaaaatgcgctccgaacatgatccgatcgagcaggtcaaaaaccgcctgatcgaaaagggctgggcaaccgaagaagagctgaaggaaatcgacagggaagttcgggacattgtcgctgatgctgccgattttgccgaacatgatccggagccggatgcgtccgagctctatacggatattctgctctaa

SEQ ID NO: 476 - DNA, 1095 bp, Brucella melitensis
ttgatcgggttcaatctgttccgctcgaagatgatcaaggatttttttgccaatatgcagcagccagcgcagacggtttccaccgtaaccgttgagcccggtgtgtggcagccgggcgtggaagccatcggcaccgccagcgcgctcaatggcgtcgatctgaccgtgcagcttgacggtgtcttgcagaagatcaacttcaaggccaatcaggacgtgaagcagggcgatattctcctgcaaatggaagacagtatccagagggcggaccttgccgccgcggaggctgaggccgttcttgcccagcagaatttgaagcgcgccgatacattgcgtacgcgcggcgtgggcgcggtatcgaatgtcgatacgactgccatgccggcgaatgccgctgtcgcactggtgaaaaagatgcgcgccacgctggcgcagaagtcggtcaaggctccgttttcgggcgtcatcggcattccgaaggtcgatatcggccagtatctgacgccgggcacggtgatcgctaccttgcagaatatcgatatcatgcgcattgattttacggtgcccgaacagctgcttgcaaccataaagcttgggcagaccgtgaaggtgggttccaatgcggacacacttgattttacaggcaagatcgtcggcattgaccccaagatcgacccgaccacccgcctggtttccgtgcgcgcggaggtggataatcccgatcacaagctgacgccgggccaatttgtgcaggttcgcgtggaactgccggaagaaagcaatgtgattgcactgccgcagacctccatcgtgtcgagcctttacggcgattatgtctatgtggttcgccccgaacagaagcaggaaagcgcgaaggcgagcgaagccgcaaaggtgcaagagggccagaaacaggtggcgcagcaggtctttatcaagcttgggcggcggtctgcaggcaatgtggaagttacaagcggcctgaagcccggcgacatcatcatcactgcgggacagaaccgtctttcatccggtgttccggtaaagatcgacaatacggtcaatccgtccgggaacccggctgacaggcaatag

SEQ ID NO: 477 - DNA, 966 bp, Brucella melitensis
ttgcgcgacggcgtagtctggcgcgcggttgcagctacactggttgcttcgcctgccttcgcacagggtgtcgatccaaccgcaggcaccggtctcagcctgcccgagccaaaactcaatctgccgacaatcaatccttatgcctcgcctgccagccctgaaaacaatccgctggtccggacctacgaactcgacctgaaggcgaagctgacacaggagggcggcgatatccctgccggcctcgtctggcgcgttttttcccccgatgtgggaccggatggtcaattgcctctcatagcctcatccaagggtggaagcgcctcgttcaacctgccggaaggcagctatctcgtgcacgtagcctatggacgcgcaggcgccaccaaacgcattacgctttccaattctgcccgccacgaaatcatgattctggatgctggcggcatgaaacttagcgccgtcctgcccggtaatggcaagatcaaggacgatctgctgcgcttttcaatctatgccgacgaggaaaatagcgaccgttccctgatcgtgccggacgtaaagccgaacaagatcattcgcctcaacagcggaacctatcatgtcgtgtcgaattacggcacggcaaatgcaatcatccgcgccgatatccgcgtggaagccggaaagctgacagaggcaacggtgcagcaccgcgccgccgaagtaacgctcaagctggtgcgcgaccatggcggcgaagctctggccgacacatcctggtcgatcctcaatgcctcaggcgatgttgtacgcgaaagtgctggcgcctattcctcgatggtgctgatcgagggcgattatgtggccgtcgccaagaacaaggatcgcatctatcagcgcgatttcaaggtcgaatccggcaagaacgaggacgtcgaggttcttgccaacagcgattcggaagcctccgatgacattgtcgactga

SEQ ID NO: 478 - DNA, 1608 bp, Brucella melitensis
atgggccgactgattttcatcggctttcccggacttggacttgttgcgtcacatcttccacaccggaatggtccagcagaggaagggacccgaaatcagttcgggcacgacagcgcaagtcgccagagagttttccggcgtcccgtcgttatcattaaatggaattatgttcggcaagttgcgcttgcccggcgttttaaagcggaccgcgaatgcgcggtgccgctgaaagagattgaattgacaaaagaaaacacgggcggcttcgccgctctcggtatcaccggcgttctgctcaaaggcgtggaagctgccggcatgaccgagccgaaaccgatccagacgcaagccatcccgtcgcaacttgaaggccaggacatcctcggcatcgcccagacgggttccggcaagacggcggctttcagcctgcccatccttcagaaaatcatcggccttggcgacaagcgccgcccgaaaaccgcacgcgcgctaatcctggcgccaacgcgtgaactggcagtacagattgagcagacgatccgcaatgtctccaaaagcgcgcatatctccaccgcgttggttctcggcggcgtgtccaagctttcgcagatcaagcgtatcgcacccggcatcgatgtgctcatcgcaacacccggccgcctgacggacctgatgcgcgatggcctcgtggacctgtcgcagacccgctggctggttctcgatgaagccgaccgcatgttggacatgggcttcatcaatgatgtgaagcgcattgccaaggcaacacacgccgaacgccagaccgcactgttctcggctaccatgccaaaggagatcgcatcgctggccgaacgtctgctgcgcgatccggtacgggtggaagtggcgccacaaggcgccacggcttctgaaattacgcaggtcgtgcatccagtgccgacgaaggagaagcgccgcctgctttcagccatgctgaccgatgccgacatgcgttccgtcatcgtcttcacgcgcaccaagcacggagcagatgccgtcgtgcgccatcttgagcgcgaccgctatgatgttgcggccatccacggcaataagtcgcagaatgcacgccagcgcgcgctgaacggtttccgcgatgggaccctgcgcattctggttgcaacggatattgcagcgcgcggcatcgacgtgcccggcatcagccatgtggtgaattacgacctgccggacgagccggaaacctatgtgcaccgcatcggccgcaccggccgcaacggcgcaagcggcgcttccatcacgctttatgatccggctacggaagaatcaaagctgcgggcggttgagcgcgtcacgcggagcaaactttcgatcaaggatgcgccggtgaagcttgcaccagcacctgtcgccaaaggccccgcaccccagggccagcggactgaacaggctgagagccgcaaggcgcccgcgcacaagcatcgccgccccgcacagaaggcgggcgagcagcatcgcgccggggcacatgccagcgccggtgaggccgcgccgaagccgaagcgtcccttccgccgcaagcgccgcagcaatggcggccagcgcgccgcctga

SEQ ID NO: 479 - DNA, 360 bp, Brucella melitensis
gtgtacacgatccgcatcatgaactgtgccttttttgcgcatcacggtgtcttcgatgaagaacacaagctcggacaacgattctatgtcgatgccgttctggatgttgatgagggcaactcgctggaaagcgacaatattgacggaacagttcattacggaattgccttctccgtcattgaaggcatcatcatgggccgccagcgttatctgatcgaaaccctcgcgcttgatgtcgccaaggcgctcgtcgcacggtttcctcagataaagcgggctgagatcacgatccgcaagccgaatgccccggtttcgggcgtcctcgattatgtggaagtaaccgtggtttacccccagtga

SEQ ID NO: 480 - DNA, 996 bp, Brucella melitensis
atggaaacaaaagccaattacgtactggtaggggttttcacgttgctcgtaagcctgttggctttcggcttcgtgtactggattgcgcgctatggcgaagcgcgcgattccctgcctctggatgtgcgcattcagggttcggtcacgggccttggtattggtagccaggtgcttttcaacggtatcaaggtgggcgacgtgcgccggctgcatctcgatgacagcaatccgggcatggtgattgtgcagacacgcgtgaacgcgaccacgccgatcacacgttcgaccacagcaacactgggctttcaggggcttaccggacaggcttatatcgaactgaaaggcggccggctggatgagccgaaccttttgacggaggcggcgaaggaagacacggtcgcgcgtattgacgccgatccgtctgccgtgaacaatcttctggcaaccgcgcaggatattgccgcgcgcgccaacaatgtgctgagccagcttgaaggtttcgtgaaggacgcccgcggcccgctgacggacacgatcaacaacaccaaaacctttacgcaagctttggcggataatgccgatatcattcaggagcttggccagaatgccggcaatattcgccagatcgtcgtggacgcgaaggatatgatggcgcgtttgaatgcggcgtccgtcaaggttgaaagcattctgaataaaactgacaagatgttgtctgccgacgacaagaacggccttgtcgcgcaggcaatcacgacattgcaatcaattcgtgaaacctcgaataatctcgacgcgcgccttgcgccgattgccaataatctggaccgtttttccggacagggcctgcgcgaaatgcagggtgtcgttattgacagccgccgtgcaattcaacgtatagaacaagtcattaccgagcttgagcgtaatccccagcgccttatcttcggcgggccggtgagtgtgcctcaatatgatgggaggaagcgtcattga

SEQ ID NO: 481 - DNA, 2733 bp, Brucella melitensis
atgcttgagaagacctatgacgccgcggctacagagccgaaaattgccgaacgctgggaagaagctggtgcattcaaggcaggcgcaggcgcaaagcccggagccgatccgtttgctgtggtcattccgccgccgaatgtgacaggctcgctgcatatgggccatgccctcaacaataccattcaggacatcatggtccgtttcgagcgtatgcgcggcaagaatgtgctgtggcaaccgggtatggaccatgcgggcattgcgacccagatggttgtcgagcgccagcttgccgaacgcaaggagccgaaccgccatgccatgggccgtgaaaaattcatcgaacgcatctggcaatggaaagccgaatccggtggcatgatatccaatcagcttcgccgtctgggtgcttcctgcgactggtcgcgtgagcggttcaccatggacgaagggctgtcccgcgcggtgctggaagtctttgtcacgctttacaagcagggcttgatctatcgcgacaagcgccttgtgaactgggatccgaaacttttgaccgcgatttcggatatcgaggtcgaatcccgcgagatcaagggccatttgtggcatttccgctatccgctggaaaatgttcctttcgacccggaaaacccgcatacctatattatcgtcgcaacgacccgcccggaaacaatgctgggcgatactggcgtggccgtcaatccgaaggatgagcgttatcatgctcttgttggaaatgacgtcatcctgccgcttgtcgggcgacatattcccattgtggcggatgattatgccgatccagaagccggttccggcacggtcaagatcacgccggcgcacgacttcaacgatttcgaggtcggcaagcgcaataatctgcgcgctatcaacatcctcacgcccgaagcagccattacgctcaaagataatgtcgattttcttgaagatcttgagctgacagcggaactgaaggcacttatcgtcgaactcgacggaatggaccgctttgccgcgcgcaagcgcatcgtcgaactgatggatgagcgtggctatcttgaaaagatcgacgatcacacccacgcggtcccgcatggtgatcgcggcggcgttcccattgagccatatcttaccgaccaatggtatgtgaatgccggtgagctcgccaagcctgccatggcggcggttcgtgatggccgcacacagattgtcccgaagaactgggaaaagacctatttcgactggatggaaaacatccagccatggtgtgtctcgcgccagctctggtggggacaccagattccggcctggtacggaccggatagccattgctttgtggaaaagagcgaagctgaggccaaggccgccgcacgcgcccattacggtgaagacgttgcgctggagcgtgatacggacgttctcgatacgtggttctcgtctgccctctggccgttctccacgcttggctggccggacaagacaccggaacttgcaacctattacccaaccagtgttctggtgacggggttcgatatcctgttcttctgggttgcccgcatgatgatgatgggccttcatttcatggaggaaatcccgttccatacggtctatctgcatgcactcgtccgcgacaagcatggcgcgaaaatgtcgaagtcgaagggcaacgtcatcgaccctctcgaactgatggacgaatatggcgcagatgccttgcgcttcacgctggccatcatggcagcgcaggggcgtgacgttaagctcgatccggcccgcatcgccggctaccgcaatttcggcaccaagctctggaacgcgacgcgctttgcgcagatgaacggcgtgaagcttgcccccgatttccgcccggaaaatgcaaagcttgccgtcaatcgctggattttgaccgaattgacccgggcaacacgcgcagtgacagaagggattgccacctatcgcttcaatgaggcggcgggtgcggcctatcgcttcgtatggaaccagttctgcgattggtatctggagtttctgaaacccatcttcatgggggatgatgaggcagccaaggcagaggcacaggcaacagccgcctattgtctggatcaggtctacaagctcctgcatcctttcatgccgttcatgacggaagagctttggtcgctcactgctagcgaaggcaagaagcgcgacaccgttctggcattggctgaatggccggaattgtccttcgaggacgaagatgcggctgccgacatcaactggctggttgatcttgtgaccggtattcgctctgttcgtgcggaaatgaacgttcctgcaggtgcgattgcgccggtcgtggttctggacgccaataaggtgacagtcgatcgctttgcccgccacgatgcggcaatcaagcggcttgcgcgcgtggaacgcatttcctttgagcaacaggcgccaaagggggcagcgcagatgctgctgggcgaggcgacgatctgcatcccgcttggcagcctgatcgacctccaggccgaagcggctcgccttgccaaggaagcaggcaagatcgccgctgaaatggatcgtatcgagaaaaagctcgccaatgagaaattcgttgccaatgcgcgcgaagaagtcgttgaagctgagcgcgagcggctgctcgaactcaaggaggcagcgcagcgcgttgcaactgccgagtcacgcatccgtgatgcaagctga

SEQ ID NO: 482 - DNA, 753 bp, Brucella melitensis
ttggttgcgcttggtatcggatattgtgccggtacggcgcgacaggcctccaagcctgtacaggctgcaacctccaccgttgcctttaacccgaaggccgtcgaaaacatcgtgcgcaattatctgcttcagaacccggaactgatgctggaagtgcagaccgcgcttgaaaccaaacaggctcatgcggcacaggaacaggtgaagcaggtactggccgccaatcagagcgttcttttcgaccccaagcatgatgctgtctttggcaacccgaatggcgacgtgacggtctatgaattcttcgattacaattgcggctattgcaagcgcgcgcttcccgatatggaagcgatcctgaaaaaagatccgaatgttcgttatgtcctcaaggagttcccgatcctggggccggattccatgcgtgcgcatgtggtctcccaggctttcaaggcgctgatgccggagaagtacccggaatttcatgaaatgctgcttggcgggcatgggcgcgcaacggaggaatccgcgattgccgacgccgtaaagctcggcgccgatgaagctaagcttcgtgaaaaaatgaaggacccggccatcaccggcgctttccagcggacctaccagcttgcgcaacagctcaacatcaccggcactccgtcctatgtcatcggcgacgaactggtgcccggcgctattggtatcgatggattgcggcagagaatcgcggccgcccgggacgctgcaaagaagtaa

SEQ ID NO: 483 - DNA, 1437 bp, Brucella melitensis
ttgaaggcgctgatcaaaggcgataagggaattgccatgtcaaacaataccgatctctcccccgttcacgtcattggcggcggccttgccggcagcgaagccgcctggcagatcgcacaggccggcgtaccggtcgtgctgcacgaaatgcgcccggttcgcggcaccgatgcgcacaagaccgaacagcttgcagagctcgtctgctccaactccttccgctccgacgacgcagaaaccaacgccgtcggtgttctccatgccgagatgcgccttgccggatcgctcatcatggcttgcgcggatgcccatcaggttcccgctggcggtgcgctggccgttgaccgtgaaggcttttcgcaggccgtaaccgccagactggaagcccatccgctcatcaccatcgagcgcgaggagatcaccggcctgccgccgaccgaatggggaacgacgatcatcgccaccggcccgctgaccgcaccgtcgctggccgaagccatcgccgctgaaaccgatgcggatgcgcttgcctttttcgatgcaattgcgcccatcattcatttcgattcaatcaatatggatgtgtgctggttccagtcgcgctatgacaaggttggtcccggcggtactgggaaagattatatcaactgcccgatggacaaggagcagtacgaagccttcgtcgccgccctcatcgaaggcgacaagacggacttcaaggaatgggaaggcacgccctatttcgatggttgcctgccgatcgaggtgatggctgagcgcggaccggaaacgctgcgtcacggcccgatgaaaccgatgggccttaccaatgcgcataacccgactgtgaagccctatgcggtcgtgcagttgcgacaggacaatgcgcttggcacgctctacaacatggtgggtttccagacgaagctgaaatatggctcgcagacgggcatttttaaaatgatacccggcctggagaacgcggaatttgcacgccttggcggcctgcaccgcaacacctaccttaactctcccgtattgctcgacaatgttctgcgtctcaaatcccgtcagacattgcgttttgcaggtcaggtaacgggttgtgagggctatgtcgaatcgtcggccatcggcctgctggccggtcgctttacggctgcggaaaagcttagtcaggctgccgtgccgcccccgcccacgacggctttcggcgcgctgcttggccatattaccggtggccatatcgttaccgatgacgaacccggcaagcgttccttccagccgatgaacgtgaatttcggcctgtttccgcccgttgacgtacccaaacccgaaggcaagcgcctgcgcggcaaggaaaagaccattgccaaaaagcgcgcgctttccgcacgcgcccttgccgattgccgaaactggctcagcttgtactga

SEQ ID NO: 484 - DNA, 1284 bp, Brucella melitensis
atgcgtttaccaattttgcagcatacgtccgaacgtctcctgcggaatgttgcaatcgttctgattgccggttttggagccgggtgcagtgctgatacgatgcgcttcacagacggcatttttactggttctacgtccagtcagcccgtcgcgcagcaacccgcaggcaatgtttatgcgtctgcccccgtggcttcggccccgccggtttcaagcggaacggtccagcgcaattccttgccgccggtatcgtcagcgcctctgggtgcgcctgtcgctgcggcatcgacgcagatgcgcaatcaggtcgatcaagcccaggatatggcggcgtcccgcgtcaataataccgttaatgccgctgaaaccagggtcgcaagtgccgccaccgttacgcataatacggtgaatggcgcgaaggaaaaggttcttggccagcttccggcgacggggcagggcgcgccgcgcccgatggacaacaatatcgctggcgttccgcaagcacctgctgtcaacggcaagaaatcctcgccgaccaatatggcatcggctggcggcgctatcgcaaccccgccatcagtgggcggtgcctacgtcgtgaagagcggggattcgctgttctccatcgcaaagaagcacaatgtccctgtcgaccagttgaaggcggcaaacggcctgaccagtggcgccattcgcgtcgggcagtcgctcgttattccgtctgctgccgcaggtgcgccgacacaggtggccgcaatcacgccgcagccggcaaacccggccaaagcagccagtgcgccggccaatggaggtgcagaggtaaagccttatacgccgccgcaggccagcaacaaggtaatcgaggatgcggaaaaggatcaggccgcagcgccatcctcaaccggcatctcgcagatgcgttggccggttcgtgggcgcattctggcaagcttcggccagcgtgagggcacctcggtcagcgacggtatcgatatcatggtgccggaaggcacgccggtcaaagccgccgaaaacggtgttgtgatctatgcgggcgatggtttgaaggaatttggccagaccgttctgatccgccacgacaatggccttgtgaccgtctatggccataacagccagataatggtgcagcgcggccagaaggttcgccgtggcgaggaaatcgccaagtcgggcatgagcggcaacgccaagtcgccgaagctgcacttcgaggtgcgcaagaactcggcgccggtcaatccgaccaaatatctggaatcataa

SEQ ID NO: 485 - DNA, 924 bp, Brucella melitensis
atgttcaagctgaaacttctgctcttccgctggtcgcgcaagctgaagcaattcaattactggctctgggcacaagccgtttttgtgctgctcgggtttctgcgcctgtttccggcaaaagcggcaatcagcttttcggccagggtggctcgtcttatcgggccgctgacgccgcgtcataaggtggccaccgacaatctgcgcaaggcctatccggaaaagagcgaagctgaaatcgtgaagatcgcccgcgaaatgtgggattcgatggcgcggcttttcgcggaatatatcttcctcgatgcggttttcgatttcgatccctatgccgtaaaaccggggctggtcgaggtggaaggcattccgattttcgagggcctgcgcgacgaaaagaagccgcatatcttctttaccgcccataccggcaatttcgagcttctgccgatctgcgccgccactttcggcctcaatgtcacggcgctgtttcgcccgcccaacaatccctatatcgccaacaaggttttgaaggcgcgccgcacgaatatgggtcatctggtgccatcgaaggccggtgcggcatgggcgcttgcgggaatcctcggcgatggcggcaatgtcggcatgctggtggaccagaaattttcgcgcggcgttccctccacattcttcaatcgcccggtgaagaccaatccgctgctcgccaagctggcacggcaatatgattgcgatgtctatcccgcgcgctgcatccgcctgcccggcgggcgttatcgtctggaactctatgagcgcatggaattgccgcgcgacgaatccggccagatcgacattaacgcaaccacgcaattgctcaacgacaccgtggagcaatgggtgcgcgaatatcccggccaatggatgtggttccacaagcgctgggggtag

SEQ ID NO: 486 - DNA, 270 bp, Brucella melitensis
atgtctctcttttccggcattgcgatctatttcatcatctggtggacagcactttttgcgctgctgccttttggtttgcgcacgcaggccgaggaaaacgaggtgacacttggaaccgtcgccagtgctccagccaagccgcatatcgggcgcgctttcttgcgcaccaccgttgccgccacgcttatcttcctgctctattattatctgacgcaggtaagcggtctcggactggacgatattccccatttcttccccgatctgacataa

SEQ ID NO: 487 - DNA, 402 bp, Brucella melitensis
atgaaaaagctgtttattttggccgctgggatgatgctggctggctgcattactgatgctggaaaactggaagatcggattgccgctcaaagagcgccttcaccggccataaagcaactcatcatcaatgaggcgcggaatatcctgctcgatccatattcggtccgcgatgtctcgatttcatcccttattccgaatctgaaaagctccaataatgatgggttcatatgcgtccgcttcaatgcaaagaatagctatggcgcttatacgggtctaaaaacggtcggaacaaacgtcattagtgggcggctacttggatattttaccaatccagccatatgcgcatatcctaccgtgaagtggcaccccttgccggaagtttcgcaactgcgcaaactgtga

SEQ ID NO: 488 - DNA, 453 bp, Brucella melitensis
ttggcgccacccacacagtggctcctctttatttgccgtcactgccaaggagtacataaacagatgcagcttaaatccattcttctggcactcggcattggtgcggcgggattaacgctcagcggttgcgtatcggaaagctattacggcaccagcggcggatattatgatccctattatgtgcgcggcggctatgtcggcagcgccatcatctatgatagcgggcgttatcgcgctcctcgccgttaccacagttatcgccataatcatcgcccgaaccgcccagattataacaggcctcaccgcccgaaccggcccgattacaatcggccaaatcgcccggaccggcccggcaggccggatcggccgcatgtgcgccccggtgacggcagctccagcggcagtggcaatcacaggccaagaatccacgcccccgaacgcggcccgcgctga

SEQ ID NO: 489 - DNA, 699 bp, Brucella melitensis
ttggcgctgggcgccattctggctcttggcgcattcagcctgtggtccactgcgcagcacaaaagcccacaagcggctttatccgcgctattccagcgtcccgcgcccaagcccgccccggcagctacagccaaggctgaaaacaagcccgcgcccggcaagactgccgatacgaaagcgccagccagagattatgcggccgccgttggccctgttccccgcccggcagcaccggttgcgcccacaccgcaaaagcccgtccagaccgcggccgtcgcggcgcccaaaccgccccgcccttccgggagcgtcgtggcatcggttacacccgctgcacctcacgccatgccaccacgcggcgtcaatacaccggcaaactcgccgtcggttatctatgccaaggccaagctcaccattcacaagaatgcctgggaccgttcgccagccattgccaccattgagaaaggccgcgaaatgcgctcctacggcaagacaggccgctggcatcgtgtggttgtaccctcgacgaacatcatcggctgggttcacgaggatcaattgatcggtggacacaacaagccggacagcgcaacgctcattaccggatcagttgccaaaaaggcgccatcgcccgcgtccacgcccgctcatgtgcaatcacacatcctgccgccaaaggctgtcggcgctaaaaactag

SEQ ID NO: 490 - DNA, 954 bp, Brucella melitensis
atgtttgcaagacctcttatcgcctccatgctaggcgctgccgtttgcttgacggcgcttggaacggttgcggctccagctttcgccgcaggagaatccgaggtcaaagtcatcgtgtccggcaatgctattaccaatagcgacatcaagcaccgcatggccttcctcaagcttcagcgtaaaagcggcaatctcaaccagcttgcgcgcaacgagcttaccgaagaaatgctcaagcgcatcgagatgaaatcgcttggcatcaatatttccgataaggaagtgaatgacgcctatgccgggtttgcaagccgcaacaagatgacgctggcgcagctcaatcaggttatgaaccagtcgggcgtcacgccggaacatttcaagaaatatatcatggtccagatgggctggggccgccttgtcagcgcccgcttccgcgcgaccggcatggtcagtgagcaggaagccgtgcagcgtatgctgaagaacggcggaaagaagcccgttgcaactgaatatcatctccagcaggtgattttcgtggtccccgcctccaagcgttcgcccgctcttctggcaaaacgccgtcaggaagccaatgcgttgcgcgcgcgcttccagaattgtgacagcacgcgccagcaagccaagggcattctcgatgtgaccgtccgcgatcttggccgtatcatcgagccgcaattgcccggcgaatggtccaaggatgtgaaggccgctggcgtcaaccggacgaccaagccgcacgatacggaaaagggtgttgaattcctggccgtatgctccacccgtcaggtgtcggatgaccgcgttgcacagcttgtcttctccatggaaggcgcggattcccctgcggggcaggaaaagaaggctgaggaactcagcaagaaatacgtgcaggaactgcgcgaaaaggccaccatcgtcaatcgttga

SEQ ID NO: 491 - DNA, 1542 bp, Brucella melitensis
atgtccagagccaggatttccaactatcgcaaaggcgttgccgccgtcgcgctttccgcagcgcttgccggcgcattcgtcgtaaccggcccgcttggtgcgctgaacgaagcccgcgccgaagcggtgcatgtgacgccgccgcagcaggctggctttgccgatctggtggaaaaggttcgccctgcggtcgtcagcgtccgcgtcaagaaggacgtgcaggagacttccaaccgtggtccgcagttcttcggccctcccggcttcgaccagttgccggacggtcatccgctgaagcgatttttccgtgattttggtatggagccgcgtggcgattcacgctccgataaccgtcgcggcaaggccaacaagccgcgcccgggccatgaacgccctgttgcacaaggatcgggcttcgtcatttccgaagatggctatgtcgttactaacaaccatgtcgtttccgatggcgatgcctataccgtcgtgctggacgacggcaccgaacttgatgccaagctgattggtgctgatccgcgcacggacctggccgtgttgaaaatcaacgctccgaagcgcaagttcgtctatgtcgcctttggcgacgataataaggtgcgcgtcggtgattgggttgtcgcagttggcaatccgttcggccttggtggcacggtgacttccggtatcgtttcggcccgtggccgagacatcggcgcaggcccctatgacgatttcatccagattgatgccgccgtgaacaagggcaattccggtggtccggctttcgacctttccggcgaagtcatcggcatcaacaccgccatcttctcgccatctggcggcagcgtgggcattgcttttgcaattccgtcctccaccgccaagcaggtcgtggaccagctcatcaagaagggttccgtcgagcgcggctggatcggcgtccagatacagcctgtgaccaaggatatcgccgcttcgctcggtcttgccgaggaaaagggtgcgatcgtggcctcgccgcaggatgatggcccggctgccaaggctggcatcaaggcgggcgatgtgattacggctgtcaatggcgaaacggttcaggacccgcgtgacctggcgcgcaaggttgccaatatcgcccctggtgaaaaggcggccctgaccgtctggcgcaagaacaaggccgaggaaatcaacgtcacgattgctgccatgcccaatgacaaggggaagagcggcagccagtccaacgacaatgacggcggacagggtgaaacgctcgactcctacggcttgaccgtcgttccgtctgaagacggtaagggcgtggtcgttaccgatgtggacccggacagcgatgcggctgaccgtggcatccgctccggcgatgtgatcgtgagcgtcaacaaccagacggtaaagaccgctggcgatatcaacaaggccatcacggcagccgaaaagtcaggccgtaaggcggtgctgctgcaattgcagagcaatgatcagagccgcttcgtggcgctgccgatcaatcaggaatga

SEQ ID NO: 492 - DNA, 1140 bp, Brucella melitensis
atggaattctggcttgtagcagcacttttaaccttcgcagccacgctggctgtcctgttgccgctgacgcggcgcaggcaagccgctttgcccgccgaaaaaaacgaccttgaggtctatcgcgaccagcttcgcgaagttgaggccgacgttgcgcgcgggatgatcgatctgcaaagtgctcaacaggcgcgcatcgaaatctcccgccgcatcctcaatgccgaaaaggatgccatggccgcaacggctgatggcgggcagggccgttccggccgtgtgctggcgtttgttgcagttctcgccgtgccgctggtcgcctggggcatctatccgctgtttggtgcgcccgacatgccctccatgccgctcgcgccacggcttgcagccgcaccggatcgcagttccgtcaccgacctcattgcccgcgctgaagcgcatctggcacagaatccgggtgatgtgcggggttgggatgtgctggcgccgatctatctgcggcttgggcgggcttccgacgcggtcagcgcctatcacacatccatccggatcgctggcgaaaaccttgcacgaattcttggactgggcgaggctttgacggctgcttccggtggcacggttacggccgaggccgagaagctgttcaagaaagcagccgaactcagccccgatgatattcgtccgcaatattatcttgcgcagggcgaaatgcaggatggccatccggatcgtgccgctgaccgccttcaggcctttctggacaaagctccggcggatgcaccttggcgcggccagcttgagaaaaccattgccatccttcgtgatcccgcgagcgccaaacaggcggaggcgaaaggtccgagcgccgaagatgtcgaagcggcttccacgctcagcgccggagatcggcaggcgatggtggaaggcatggttcaacgcctcgatgaaacacttcgccagaatggcggggatatcgatggctggaagcggctggtccgctcctatatgatcctcaaccgccgcaacgatgcgcaggatgcgctggctcgcggcatgaaggctcttcagggtgaaaaccggaccgaacttcaaagcttcgccaccacacttggactggacgtggggactgcacaagaatga

SEQ ID NO: 493 - DNA, 927 bp, Brucella melitensis
ttgacggcgggcgcgctggcttttgccggtgcagcaagcgcacaggataagaaagtgacgatcggcgtgtcgatcccggctgccgaccatggctggacggcaggcgtcgtctatcacgccgagcgtgtggcgaagcttctgatggaggagcatccgggcctcaacgtcatcgtcaagacgtcgcccgatgccgcatcgcaggccaatgctttgcaggatctggcagtgcaagggttggatggcctcgttgtcctgccgactgatcccgatccgctggtcaacgccatcaaggagatcaaggacaaggggaccttcgtcgctctggtagaccgcgcgccgagcaacaacgacaataccatccgcgatctttacgtggctggtaacaagcccgcactggggcaggtggccggtgaatatatcaaggccacgaccccggatgcacaggtcgtcgtcattcgcggcctgccaatcccgatcgatcagcagcgccaggacggtttcgataagggtatcgagggctccaatgtcaaggtgcttgaccgccaatatggtaactggaaccgcgacgatgccttccgcgtgatgcaggacttcctgaccaaatatccgaagattgatgtggtctgggcgcaggatgacgacatgctggttggcgttctcgaagctatcaagcagtccaatcgctccgacattcaatatgtcgtgggcggcgccgggtccaaggatatgattaagcgcgtcatggatggcgacaagcttgtgccggttgatgtgctttatccgccagcgatggtttcaaccgcaatggaactcgccgccggtcatttctatgaccagattccggtcagcggcgactatatcctcgacgcaacgctcgtcaccgaggataatgccaaagatttctatttcccagattctccattctga

SEQ ID NO: 494 - DNA, 2793 bp, Brucella melitensis
ttgtcgcggcccgacttttttggttggccctcggcttctgatcgcataagcaacgcaagcaggttcagggagtgcttgcagcaattgcaggtctttcgggaaccttgtcctgtgtcaagggaggccggaatggcaaagtgggtgtacacgttcggtgatggcaaggcggaaggggctgcgagcgatcgcaaccttctcggcggcaagggggcgaacctggctgaaatgagcagccttggcctgcctgtgccgcccggctttacgattaccaccgaagtttgcacttattattacaataacgaccgcgtctatccgtccgaactggatgcgcaggttcaggcggcgcttgcgcatattgcaacgcttaccggtcgtaatttcggtgatgcggaaaaaccgcttctggtttcggtgcgctccggcgcgcgcgcatccatgccgggcatgatggatacggttctcaatctcgggctcaatgacgagacggtgcaggccattgcccgcgaatcgggcgacgaacgtttcgcctatgacagctatcgccgctttatccagatgtattcggatgtggtcctgggtgtcgatcatggcttcttcgaggaaattctcgaagataccaaggcggatctcggtgtcgaggtcgatacggcgctttccgccgacgactggaagaacgtgatcgggctttacaaggcaaaggtcgaggaagaactgggccagcctttcccgcaagacccgcgcgagcagctttggggcgcaatcggcgccgttttctcaagctggatgaacgcacgcgccatcacctatcgccgcctgcacaacatcccggccgcatggggcacggcagtcaatgtacaggccatggtcttcggcaatatgggggaaacctcggctacgggcgttgccttcacgcgcaacccatcgacaggcgaaaacaagctctatggcgaattcctcgtcaatgcccagggcgaagacgtggtggccggtatccgtacgccgcaaaacatcaccgaggaagcgcgcatcgccgccggttccgacaagccctcgcttgaaaaggtgatgccggaagcctttgccgaatttttgaaagttgcaaatcgtctggaacagcattatcgcgacatgcaggatctggaatttaccatcgagcgcggcaagctgtggatgctccagacgcgctccggcaagcgcactgcgagggctgcgctgaaaatggccgtggaaatggcggcggaagggctgattagcgaggaagaggcggtgttgcgtatcgaccccgcagcccttgaccagcttctgcatcccaccatcgatccgcgcgccgagcgtcaggtcgtgggcatgggcctgccagcttcgccgggcgctgcaactggcgagatcgtgttcagctccgaagaggccgaacaggccaaggcggaaggccgcaacgttattctggtccgcattgaaacgagccccgaagatattcacggcatgcacgctgccgaaggcattttgaccacgcgcggcggcatgaccagccatgcggcggtggttgcgcgcggcatgggcaagccctgtgtttccggcgccggttcgctgcgcgtcgattaccgcaatggcaccatgctggctgctggccagaccttcaggaagggcgatgtcatcacgattgatggcgcaagcggccaggtgctgaaaggctctgtcgccatgttgcagccggagctttccggcgatttcggcaagctgatggaatgggccgaccgtgcgcgccgcatgaaggtgcgcgccaatgccgaaacaccagccgatgcccgcactgcgcgctcatttggtgcggaaggcatcggcctttgccgcacggagcatatgttcttcgatggcagtcgcatcgtcgccatgcgcgagatgattttgtccgataccgaggaaggtcggcggctggcgcttggcaagcttctgccgatgcagcgttcggattttgccgaactgttcgagatcatgaagggcctgcccgtcacgatccgcctgctcgatccgccgctgcatgaattcctgccgcatacggatgaggaagtggacgaagtcgcccggtccatgggcgtcgatgctgcgaagctgcgcgaccgcgccgatgcgctgcatgagttcaatccgatgcttggccatcgcggttgccgtctggctgtttcctatccggaaatagccgaaatgcaggcgcgcgctattttcgaagctgccgtggaagcgggcaagaagaccggcgagccggtggtgccggaagtgatggtgccgctggtgagcttgaaggcggagcttgatttcgtcaaggcgcgcatcgatgcggtggcgaaggaagtcatgagcgaggcaggcatcaagatcgactatatggtcggcacgatgatcgagctgccgcgcgcggcactccgcgcggccgagattgccgaatctgcggaattcttctccttcggcaccaacgacctgacgcagacgaccttcggtatttcgcgcgatgatgccgccggcttcctcacgacataccagaaccgcgttgtgatcgagcaggatccgttcgtttcgctcgacgtggacggtgtgggcgaactggtgcagatcgctgccgaacgcggacgcaagacgcgcgaaaagatcaagcttggcatctgcggtgaacatggcggcgacccggcttccatcgccttctgcgaaaagacgggtctcgactatgtgtcctgctcgcctttccgtgtgccgatcgcccgccttgcggcggcgcaggcagccgtgcgcaaagtgtaa

SEQ ID NO: 495 - DNA, 3465 bp, Brucella melitensis
ttgctgatgcgcttctccaggctgcgccttgtcgggttcaaatccttcgtcgagccgatggagttcgtcatcgaaggcgggcttacaggcgttgtcggccccaatgggtgcggcaagtccaatctggtggaagccctgcgctgggtaatgggtgaaaactcctacaagaacatgcgcgcttccggtatggacgatgtgattttttccggttccgcgacgcggcccgcgcgcaatacggcggaagtgacgctttttctcgacaattccgaccgtacggccccacccgcctataacgacgcggatgaattgcaggtgtcgcgccgcatcgagcgtgaggccgggtcgctctaccgcatcaatggcaaggaagcacgcgccaaggatgtgcagcttttatttgccgatcaatccaccggtgcgcgctcgccttccatggtggggcaggggcatatcggcgagttgatacaggcaaaaccgcaggcgcgccgtgcgcttctggaagaggcggcgggcatttccggcctgcacacgcgccgccatgaggcggaactgcggctgcgcgcggctgaaaccaatctggagcggctggatgatgtggtgggcgaactgggcagccagattgaaagcctgaaacgccaggcacgccaggccaatcgcttcaaatcgctttccgcagatatccgccgcgccgaagcagccttgttgcacctgcgctggaatgtggccaaagggcaggaggccgaggcgcagagcgcgctgtcgcaggcgaccgcgaccgttggcgatatggccgaagcgcagatgaaagccgcgcgcgatcaggctgtcggcgcgcataaattgccggaattgcgtgaggcggaggccggggctgccgcagccttgcagcgtctttccattgcgcgcacgcaactggacgaggagggtgagcgcattcgcgcccgccgtgccgaactgatgaagcggctggagcaactgactgcggatatcgcgcgcgaagaacagatgttgcgcgaaaatgccgatattctggcccggcttgatgaggaggagcaggaactggccgcttccagcgaggcatccggtgaacgcaatgaggaattgcgcgcgctgttcgaggaagcggaaatccgcttgcaggatagcgaaagcgcgcttgcccgcttgacggcggagcgggcggaagccgctgccgagcgcgcgcaggtcgagcgggcgctgaaggaagcgcaggaccggcgtgaccgtctggccgtgcagatggaaaatatcgagcgcgatatcgcagccgtggttggacagatcggcggtctgttcgatccggcggaaaagcgcatcgtggtggatgcctgtacgcaagccctggaagcggccgaagaagcggttgtcgcggcggaagaactggtcgcccatgcgcgcgaggcggaagccgcaagccgccagcccttgagcgaagcgcgcacggaattgaaccgtatcgaaaccgaggcacagacgctggcgcgcattctcaatgcgggcgagacaggccaattcccgccggtcgtcgaggaattgcgcgtcgaaaagggctatgaagtggcgcttggcgcggctttgggcgaagatctcgatgcggcaagcgatgagaatgcgccggtttactgggcctataatcccgctgccgaaaccgatccggccttgccggaaggggccatgccgctcgatcgcctggtggatggcccacagcaattgcgccgcaggctggcacaggtgggcgtggtttcggaagcggacggcaggcgtttgcaggtaggcctgagaccggggcaaaggcttgtgagcaagacaggcgcgctctggcgctgggacggctatacggcgagcgccgatgcgcctacgcctgccgcgcagcgtctggcgcagaagaaccggcttgccgaactggaacaggatgcaatcggcgcgcgcaggcgcgtggaagatgccgggcaggcggtggaacgcgcggaagcggcagtgcgcaaggccgttgaggacgagcgcgtggcgcgcgatcaatggcgtgccaaccagcgcaagctggatgaggcgcgtgaagcactggccgcagccgagcgcgcggcaggtgagcttgcaacgcgccgctccgcgctggatgaatccagggcgcgtctggaagaaaatcttgaagaagcgcagatccgtgttgcggaagccggggatcgccttggcgaaatgccggatatggacgcgattgcccagcgcctttcggcgctgacgagtgaggtgcagtccgaccgcgcggcgcttgccgaggcgcgggccgcctatgaaggacttcgccgcgaggccgatgcgcggttgcgccgccttgaaatgattgcactggaacgccgcaactggatttctcgtgccgaaaatgccgatcgccagatcgctgcattgaacgaccgccgggcggaaaccgccgaagaagccgaggtgttagcggaagcgcctgacgaaatcgaaaaccgccgccgggcacttttaaacgagctttcgctggcggaagagcgtcgcagggcggcggcggatattctggcggaagcggaaacccggcaggcggaactcgacaaggcggccacgcttgcgatccagcatcttgccgcaagccgcgagcagcgcgcgcgcgccgaagaacggctgaccgcagcgcaggagcgccgcaaggatgccgaagcgcgtatttttgaagccttaaactgtccgccgcatgaagcgatccgccatgccggtctgaagccggaagacgccatgccggacccggaccagcttgagcgccagttggaacggctgaagatcgagcgcgagcgtctgggcgcggtgaacctgcgcgcggaggaggagagccgggagctttcggaccgtctcgacgcgcttatctccgagcgtgaggatgtgattgaggcgatcaagaagctgcgtcaggcaatccagagcctgaaccgcgaaggacgcgaacgtttgctggcggcattcgatgtggtgaatgcgcagttccagcgcctgttcacgcatctgttcggtggcggtacggcggaactgcaactgatcgaaagcgatgatccgctggaagccgggcttgaaattcttgcccgcccgcccggcaagaagccgcagacgatgacgctgctttccggcggtgagcaggcattgaccgccatggcgttgatttttgcggtcttccttaccaatcccgcgccgatctgcgtgctggacgaagtggacgcgccgctcgacgaccataatgtcgaacgctattgcaacctgatggacgaaatggcggcttcgaccgaaacgcgcttcgtcgtcatcacacataatccgatcaccatggcgcgcatgaaccgcctgttcggtgtgaccatgggtgagcaaggggtgagccagcttgtctcggtcgatcttcaaacggcggagcagctacgcgaggcaagttga

SEQ ID NO: 496 - DNA, 1239 bp, Brucella melitensis
gtgaattcagaggagaaacccggaaccaatcctgctgaacagcagtccgtatccgagcctcagaacgaggctgtgccaaccgcgccggaaaaggctgcggaacctaagccttttgtgccgaaatccgcttccgaagccttgcgcccggaacccggcacaccgccgccccgcaatcgctcgcgccatgcgcgcagccagatcgtcgttttcatgaacttcatgctgtcgcttgtcgtgctggttttgcttggcgcgtcggcattgttctatttcggcaaattacagtttgatgcgcagggcccgctcacggcggaaacgacctttctcgtcaagcgcggcgctggcattgccgaagtgagcaacggtcttgaaagccgcgatatcgtcagcgatgcgcgcattttccgctatggcatgcgcacgctcgggcatgaaaacgacctgaaggcgggcgaatatgccattcccgtcggggcgtcgatgcgcgacgtgatgaacatcctcatcagcggcaaatccatcatgtatcccttcaccgtgccggaaggcctgacggtcaagcaggtgttcgaccgcatcgccgccgacccgatcctcattggcgacatgccgaaggaaatgccgccggaaggctcgctcttcaccgatacgctgaatttcacccgcggcaccacgcgttccgagataattgaccgcatgatcgcctcgcagaagaaactggtggacgacctttgggcaaagcgcaggcctgacctgccggttcgggacaagaacgaatttgtgacgcttgcctccatcgtggagaaggaaaccggcattgcttccgagcgtccgcatgtggcttcggtcttcgtcaaccgtctgaacaaggggatgcgtctccagtcggacccgacgatcatctatgggcttttcggcggcgcaggcaaaccgtcagaccgcccgatattcaagtcggatatcgagaagcccacgccttacaacacctatatcatcaatggtttgccgccgacacctattgccaatccgggcaaggcggcgcttgcggcggtcgccaatccgctccagaccgacgacctctattttgttgcggacggcacgggcggccatgtattctcggcgaccctgaaggggcacaatgacaatgtgcgcaagtggcgggccgcagaacagcaaaagaatatcgggcagcagaaagatacatccggcggctccggcaaacccgataccgggcagtag

SEQ ID NO: 497 - DNA, 375 bp, Brucella melitensis
ttggcacaggaaaacgggcgctaccggctggaaggcacggaaaccggctatgtgcggctcgatacacaaaccggcgcaatctcggtgtgcacgcagcagaagggccagttggtctgcaagatggctgccgaagaccgcgatgcttatgagaacgacattgccgatttgcaagcgcgcgtgaagaagcttgaagcgcaggtcgcagccatgggcaaggtggagggcagcaaggcgtccgccctgccgtccgaacaggaattcgagcaatccatgagctatatggagcgtttcatgcgccgcttcatggatctggctaaaagctttgaaagcggagaggaaaagcctgctccccccacaataccggggcggacctga

SEQ ID NO: 498 - DNA, 1152 bp, Brucella melitensis
atgaaatcctggaagcagattgctctgtgcctgctcatcattctcgccgccacaggtggctggtatgtttataagaacaacaatggcgcggcgcaattggccctatcttctggagatgcgcccggcaatgtgtctcaggctcagcccaaaaaacagccgaagaaccatgcagccccccttgtcgtggtggcggcggccggcgaagaaaccatcaataatcgcctgaccgccatcggttcggcgcgggccctgagcacggtttccgtgacgccctattccagcggctacatgaccaagctccatgtcagggcgggcgatacggtgaaggaaggcgatctgattgccgaactggacgccgaaaccgagcagattgccgttgccaaggccgaaacggcgctgaaggatgcacaaaccacccgccagcgcattgcacggctgcgtgcaaccaacacggcgaccgaagtgcaggccgtgggggccgaacttgctgtcgccaatgcgcagcttgcgcttcaggatgcccaacttgcgctgagccgccgcatggtgcgcgcgccgatcaccggcattgtcggtattcttccggtcaatgccggcaattacgtcacggcacagacttccatcgcacgcatcgatgaccgctcgaccgttctgatcgatatctgggtgccggaacgtttcgcaccgcagatcaaggtcggacagccgctcaccgcagaatccaccgctttccccggcgagatttataagggccggatcaatgccgtggacaatatgctggatgaggcaagccgcaccctgcatgttcgtgccgaagtgccaaatgccgaggaccgcctgcgtgcgggcatgtccttttcagtgaccattctcttccccggcgataactatccctcggtcgatccgctggcgatccagtggggggctgacggctcctatgtctggcgcatcgaaaacggaattgcgaagaaaatacccgtccgtatcgtgcagcgcagttccgacaatattttgatagacggcccggtgaagcggggcgacatgattgtcacgcagggcgtacagaccgtgcgcgacgatgcgccggtgcgcgtgaagggcgagcagggcgtcagcgctcttgcccccgccgcaatgcatgacgaagggtga

SEQ ID NO: 499 - DNA, 1917 bp, Brucella melitensis
atgagcgccctcgctggcaacatcaagcaggcgcgtgctgacaatgccgaaaaggctggcattgagggcgctgcaaagaaatttgctgggcttgaccttgggagcctcctgagcggtggcgcggcttatccatcggctgttgctggcggtgcttctcccacgagcggagcagcgaccggtacaacgcccactacaggcgctacggttgatctttctggcgataaacagaaattcattgatacgcttttgccagcagcaattgaacatgggcagcgcatcggtgttgatccgcgtatcatagttgcgcaggccgcacaggaaactggctgggggcgctctgcgcctggcaacaatttctttggcatcaaaagccacggtcagggcggcggccagaaccttacaacgcatgaggtaatcaatggtcagcgcgtgaagatcaacgatagtttccgcacttttgccagtccgcaggatagcgttgccggttatgctgatttcatcgccagcaacaagcgctataggcctatgcgggaagcgcagggattggacgcacaattgcaggcgcttggcgcgtcaggctatgctactgacccaaattacgcgcgctcagtcggtgctattgcccgatccatcaatttacctcagcaggcacagccacagggcgtgcaggttgcaagccttgatccatctatcggaatggctcaggcttatgcgccagaaccgcagccgcagaccgcagcggcagcaatcaaccagattgcaccacagcagccggtgcccgaagccaagatcagtgatgctctcttgcgacagaatgatatggcacttggcggtgcgctcgctccgcaggggcaggctccacagcaagttgctgacacatcgggctatttcccggctgcaccgtcagcagatagcgccccgatcatggggagctatgcagcgccacgccagggaggcgtgaatatccagcggttgcttgaggctgcatccgatccatggatgaatgacgcacagcgttccgtcatcggcatggccttacagcagcagatgcagcagaatgacccgatgcgggctttgcaggctcaaaagctgcaactcgaaatggacgctctgcgcgccaagccacagactgaatatggctttacgacactaccagatgggacggttttgcgcacggataagcgttccggcaatgcagagccgatctatagcgcgggccagaaaccaacgagtgacatgcaggaatacaattttgctgtgagccaaggtttcaagggcagtttcgctgattatcagcaggcgatgaaaaaggctggcgcgagcagcactaacgtttccgtgggcgagggcgataagttctatgaggctctggacaagaaaaatgcggacacgttcgccgcgctctcggacgcagggatacaggcacgttccaagctggcccagattgaacgccttggcgggcttatgcaggcttcaccgaccggcgcgacagctgtgctgaaacttgccgccggtgaatatgggatcaagacagacggtctcgatgatttgcaggctgcacaagctttgatcaatgagcttgttccgcagcagcggcaaccgggctccggtcctatgtccgatgctgacttggcgctgttcaagcaatctctgccccggattattaatacgcctgacggcaaccaacttattctcgacacgatgcgcggcatcacccagtaccaaattcagatgggtgatattgcagatcaggttgccaatcgggaaatctcggcggcagagggccgaaattggatcaaaaacctgaagaacccgctcgaaggcttccgcacatccacaaaggataaaactcccggaaagagcggagtttcgggaaataggcttcgtttcaacccgcagactggtgatttcgaatga

SEQ ID NO: 500 - DNA, 690 bp, Brucella melitensis
gtgaagacgccaaaaggaaaaggcaaaaagccatcaggcggcaaacaggagcgcggcttcgagcgcaggaagcaggatgcgccgcgcacggaaaacaagtttgaaagcaggaccgaaggcaagggcgccttcaagaagccgcgcccgcaattcgccaaggctgcgccgaaaccggctgaggaaaaggcgcccggaccgcttcgcgaaatcaggccctatacgggcccgcgcccggccgagcgcctgccgctcattcttgaaaccgagccttcgcccgattatgcgctgctggacagcggcaacgggctgaagcttgaacaatatggcccctatcgcatcgtccgcccggaggggcaggcaatctggctgccagccctgccgcaaagggaatgggatcaggccgacgctatcttcaccggcaatacggatgaagaaggcatggggcgctgggcgttcccgaaaacgccgctcggcgaaacatggccgatgcagcatgatggtatttccttccatggccgcttcacttccttccgccatgtgggggtttttcccgaacaggctgcgcactggtcgttcatggacgggctcatccgcgatgcggtgaaaacgggagcacggtcaaggtgctcaatcttttcggctatacgggcgtggcttcactcgttgccgcacgcgctggcgcggaagtaa

SEQ ID NO: 501 - DNA, 738 bp, Brucella melitensis
atgataagatcagtcttggagcataatccgaccgcagcgaaacgagggcgatcaagattatgctttggaaagaaaagcttggagcgccgatctgtttcaatccgattgaaacgcgcgctcaagcgtcttgtcggcccggcttcagctttcctggccctggctttttcgcatggcagcgttgatgctgccatgcgaaaaaataaacagccacccgcgccaccctccgtttacacccaaactccaggatttgccgtcaaatctacagaaatcatggtgcccgatggggtctctgcgggggaatatcggcgcatcacccacccttttcccaactggacattggtgtgtgacgagaatttgaaggcgaaaaagcgtgtctgcaatatcacgcagacaatcatgcatgaaaaagggttggtcgtattcagctgctcgttggcggctgcggagaatggcaagccgtatatgatcatgcgcatacccgcagttgtgggggcaaggcaggaaatccgcctggatttcggtgatggaactccgatcatcgtgagtaaaacgcatggttgcgagggggcggtctgtatcgcctatctgccggttggcccacgtctgcgtgtatatattgccaagggcagcgtaccgaaggtctcttatcccgtaccggatatacgtcgcggttcggctgattggttaatgttttatgcgccgctctctggccttgcccacgcgcttgctgcaatctga

SEQ ID NO: 502 - DNA, 924 bp, Brucella melitensis
atgaaatctgtgactttcaagaacaagaactgggatatcgctgcctatttgcacacccctgccggtttcgacgaagcgaagaaatatcctgctattgtcgtggcccatcccatcagctcctgcaaggagcagacagcggcgatttatgccgcaaagctggctgaacttggctatgttgcattggcattcgacgcttcgacacaagggacaagcggtggcctcggcaaatatctggaagacctcgcaagccgggttgaggatttccgctgtgcggcggattatctcgtgacgcttgatttcgtggatgagaacaggattggcgtgctgggtatctgcggctgcggcggttacgctgtgaacgctgccatgacggaccgccgcttcaaggtggtcagtacggttgtaggtgcaaattacgggcgtcttttgcgtgaaggcgatatgtcgccggatgcggcaatcaaggccatggaagcgataagccagcagcggactgccgaagcgcgtggtggcgaggttgcaataacgtcctatattccccaatcggtcgatgcgttgaaggcttccggcatcaccgatatcgatgtgaccgaggctgtcgattattacacgaccccgcgcggccagaagccgggatcacccaacaagctcaatgtgacgagcacgggagcagccttcaactgggatgcatttcaccttgcagatcagcttttgacccagccgctgcaaattattatcggtggcggacagccgggcattttcggttcgttccgggatggttatgaattgttcgacaaggcccgttcgcaaacgaaaaacctcttcattgttcccggagccacacattacgacctttacgacaagccggaatatgtggatcaggctgtggcgcggctgaaggaattctatagcgaatatctttga

SEQ ID NO: 503 - DNA, 969 bp, Brucella melitensis
gtgttcgcgctttgcgcttccgccggtatcgccagcgcccattgctcgctcgaccagaaggaagccaaggcaggcaccttctacaaggccgcactgcgcattccgcatggctgtgaaggcaaggccacgaccaaggtgactgtagacctgcctgaaggcttcatcatggcacaaccgcaagccaaggctggctggaaaatcgagaccacgaagggcgactatgcccatggctacaagctacacggcaaggaagtaacctccggcgtcaagcagataagctggagcgacggcaacctgccgagcgatttctatgacgaattcgtcgttgtgggccagcttgcgccattcgacaaggacacaaccctttccttccccgtgacgcagttctgcggcgatgcggcttcggtcgcgtggaccgaaatcgccaaggatggccagaacccgcacgatctgaagcatcctgcgccgcaacttcgcgttctggctgccgccagcactgatgaacatgcgggccacgacgccatgagcgaacacatgaaccatgccgccatgcccaccaaggtcggcgatctggtcattaccgacccgtccgtccgcgccatggtgccgggcgcaaaggttgcgggcggtttcctcaccatcgccaatgatggcaaaaaagccgacaagctggtgagcgtcagcgcccccggcgtcaagcgcgtggaaatccacgaaatgaccatgcaggaccagatcatgaagatgcgcaagctcgaaggtggtctggacctgcccgcaggcaagaccatgcaactgaagtcgggtagctaccacctgatgttcatcgagccggaacatccctacgaggaaggtgaaaccgttccggtaacgctggaatttaaaaaggctggcaaggtggagatcaacttccccgtgacggcgaagaagggccagaccaaggaccattcggagcattccagccactaa

SEQ ID NO: 504 - DNA, 1443 bp, Brucella melitensis
atgaccacacaatattactatgctaggaagactgcgcttatctctcaatcccggcgcgtgtccgcgccaaaatgtgactgtgaaaaatccatgtcccattccgcatgcccgaaaccagcaaccgcccgccattcgcaggcacttacgggcgaaatccgcattccgggcgataaatccatttcccaccgctccttcatgtttggtggccttgcatcgggtaaaacccgcatcaccggcctgcttgagggcgaagacgttatcaacaccgggcgtgccatgcaggccatgggtgccaggattcgcaaggaaggcgatgtctggatcatcaatggtgtcggcaatggctgcctgttgcagcccgaagcgccgcttgatttcggcaatgccggaaccggcgcgcgcctgaccatgggcctcgtcggcacgtatgatatgaagacgtcctttatcggcgatgcctcgctttccaagcgcccgatgggccgcgtgctgaacccgctgcgtgaaatgggtgttcaggttgaggccgccgaaggcgaccggatgccgctgacgctgattggcccaaggacggccaacccgatcgcctatcgcgtgccgatggcttccgcacaggtgaaatccgccgttctgctcgctggtcttaacaccccgggcgtcaccaccgtgatcgagccggtcatgacgcgcgatcatacggaaaagatgctgcaaggctttggcgcagacctgacggttgaaaccgataaggatggtgtgcgccatatccgtattgtcggccagggcaagcttaccggccagaccatcgacgtgccgggtgatccctcgtcaacggcttttccgctggtggccgcccttctggtcgaaggttcggacgtcaccatccgcaatgtgctgatgaacccgacccgcaccggcctgatcctgacgttgcaggaaatgggggcggatatcgagatcatcgatccacgccttgccggcggcgaggatgtcgccgatctgcgcgtcaaggcctcgaagctgaaaggcgttgtcgttccgccggaacgtgcgccttcgatgatcgatgaatatccggttctggccattgccgcgtcttttgcggaaggcgaaaccgtgatggacggtctcgatgaactgcgcgtcaaggaatcggatcgtctggcggccgttgcgcgcggccttgaagccaatggtgtcgattgtaccgaaggcgagatgtcgctgacggttcgtggccgccccggcggcaaggggctgggcggtggcacggttggaacccacctcgaccaccgcatcgcgatgagtttcctcgtcatgggccttgcatcggaaaagccggttacggtggatgacagcaccatgatcgccacctctttcccggaattcatgggcatgatggcggggctgggggcgaagattgccgaaagcggtgcagaatga

SEQ ID NO: 505 - DNA, 1107 bp, Brucella melitensis
atgaacctgaaacttctgtccagcgtggcttttgccgctaccatcggctttgccagcgccgcttacgcagacatcaccatcggtgtgattgcaccgctgacgggcccggttgccgctttcggcgatcaggtgaaaaagggcgcggaaaccgccgtggaagtcatcaacaaggctggcggcatcaagggtgagaaagtcgtcctgaagtttgccgacgatgcgggcgagccgaagcagggcgtttccgctgccaaccagatcgttggcgatggcatcaagtttgtcgtcggcctggttacgaccggcgttgccgtccccgtttccgacgttttgtctgaaaacggcgtcctcatggtcaccccgacggctaccggcccggacctgaccgcgcgcggcctggaaaacgtgttccgtacctgcggccgcgacggccagcaggctgaagtcatggctgattacgtcctgaaaaacatgaaggacaagaaggttgccgtgatccacgacaagggcgcttatggcaagggtcttgccgatgcgttcaaggcggccatcaacaagggcggcatcaccgaagtccattatgattcggtcacaccgggcgacaaggatttttccgcgctcgtcaccaagctgaagtctgccggtgctgaagtggtctatttcggcggctaccatgctgaaggcggtctcctgtcgcgccagctccacgatgctggcatgcaggccctggtgctcggcggcgaaggcctctccaacaccgaatattgggcaatcggcggcacaaacgcacagggtacgctcttcaccaacgccaaggatgccacgaagaacccggctgccaaggacgctatccaagccctgaaggcgaagaacatcccggctgaagctttcacgatgaacgcctatgcggctgtggaagtcatcaaggccggcatcgaacgcgccggttcgactgacgattccgctgccgtcgccaaggcgctgcatgacggcaagccgatcgaaaccgcaatcggcacgctgacctatagcgaaaccggcgaccttagctcgccaagctttgatatcttcaagtgggatgacggcaagatcgtcggtcttgaataa

SEQ ID NO: 506 - DNA, 1038 bp, Brucella melitensis
atgatttcctcgaccgcggcacttgccattgctgccgttctgtcggtttccgctgcccaggcgcgcgatcagatccagatcgctggttcctccacggttctgccttatgccaagatcgttgccgaaacttttggcgagacctatccgaacttcaagacgccggttgtcgaatcgggcggttcgggcgctggcatcaaggaattctgcaagggtgtaggtgaaaacaccatcgacattgccaatgcttcgcgcgccatgaaggattccgagctgaagtcctgcatcgatgctggcgtcaaggacgttcaggaagtgcgcttcggctatgacggcattgtcttcgccaccgacgccaagggcccggactggaagctgacgccggaagacatttataaggcgctggcggcaaggctggtcgttgacggcaagctggttgacaatcccaataccaagtggaaccaggtcaatccgaacctgccggattgggacatcgccgcctatattccgggcgaaaagcacggcacccgcgaagtgtttgaagaaaaggtcctggccgacggctgcaagcattccggcgctctggacgaaatcaggaagacgggccttgatgacaaggctgcggcttcggcctgcatcgcggtgcgcaaggatggcaaggcagtcgatatcgacggtgactatgctgaaacccttgcccgcattgcttccaacaagaccggcgttggcgtttttggtctctacttctttgaaaacaatgccgacaagctgaaggtcgcaaccgtcaacggcgtcaagccatcggctgaaactgtcgcctcgggtgaatatccggtttcgcgcccgctttatttctatgtgaagaaggcgcatctgggcgttattccgggcctcaaggaatatgtcgagttcttcctgaacgatcagatgatcggcccggatggcccgcttgccgaatatggtctggtcccggcgcccgatgcagaacgtgaagcacagcgtaccgccttcagcgaaggcaagacgcttgctgcaaaataa

SEQ ID NO: 507 - DNA, 651 bp, Brucella melitensis
gtgattatttttctccagctgaggaatgttcttggtcgtcgtaccggaaacgaaaagccgccgtttgatccttatgcttcggcccgcagttccgatgccgcgcctgctggcgggggacccgacaatgtggtttcactgccgcgccgcgcaaacgaaaaggattatacggccatcgacaagatagcgcccgcaggctcccccgtgaacgagggcctgcgcgctatctatgctgtcgaccccacctttgaaccggcccgtttcgttgatggtgtgaagatcgcctatgagatgatcgtcatgtcctttgccgacggggaccgcgaggttttgaagaaccttctctcaaaggacgtctatgagggcttcgtcgcagccatcgatgagcgagaaaagcggggcgaaaccgtgcgttcgtctttcgtgggcatcgacaaggccgggatcgcaggcgccgagatgaaggggtcggaagcccatgtcacggtcaatattgtgagccagatgatttcctccaccctcgacagggacggcaaggttattgatggcgacccggacaatgtggtcgagatcaaggatctgtggacattcgcgcgcgatacgaactcgcgtgatccgaactggaagcttgttgcaaccgaagcggaagattaa

SEQ ID NO: 508 - DNA, 1914 bp, Brucella melitensis
atgcgcgccagggcatccatatcggctggccttgccatagcggcggtcgccatggtggttttgccctcgcaggcttcggctgaaacccgctctctgaagctttactatgtccataccggcgagaaggccgagattgccttcaagaaggatggacgttttctgcctgatggcctgaagcgcctcaatgttttcctgcgcgactggcgccgcaacgaaccgaccaggatggatccgcgcctgttcgacctcatctggcaggtctatcagtccaccggctcgcgtgaatatatcactgtcgtttcagcctatcgttcgcccgcgaccaacgccatgctgcgttccagtacgcgcggcgttgccaagaagagccagcatatgcttggccgcgcgatggactatttcatccccggtgtcccgcttgccaagctgcgtgccatcggtatgcgttaccagatcggcggcgttggctattatccccggtccggctcgcctttcgtgcatatggatgtcggcaatgtgcgccactggccgcgcatgagccgccgcgaattgctggcgctgtttcctgacggcaagaccgttcacattcccaccgacggcaagccgctgcccggctatgagcaggcactggcgatgatcgaaaagcgcaaggctggtggcggaaccatcatgatggccagcaactcctcttcgcggaagcgcaaatcgctgtttgctgcgcttttcggcggcggcggtgccgacgaggaagaggataatggcgataccgcagcgcctgccacggcgcgcccggcgcgggcaaccgcgcccacgcggcaggccccggcagccgtgccggcggcgcctgtggaacagccgcgtgaaaccatggttgcagcccttcctgcccgcgatgctccggtgccgatgcaggcgccgcgtccggaaaccgggcttgatgcgcaggccgcagcggcggaaacgccggttgccgccttcaatgttcctgtgcctgcccacaagccgcaaatggccccgcaggatgccgtggcgctcgccgccgccgaagatccggctgctgctgcacgcgctgccgtggatgccaatacggcacaggttgccgatgcaggcatgtctgccgcattgacgaacggctttgtgcccgtcccctcggcccgtccgcatcttgaaacagataatgtgcagcttgccgccgccgttattccgactgcccgccctgaacgtcccggtgagcatccggcaagggggcaggatgcgattgcggccctcgtcaacagccagtccgatgagcctgcccagatggccggtgagatggctgacgcgacaggcaatgcggttgcgccgcagccgggtaaaacggcggctttcccgctgcccacgcaagcgccgcgcgccgacacgaagcttgccatggtttccaggcgtgatgaaattggcgagctgatcgcgccgcctgaagacgattacgattatgatgccaagccggttgcagccgctgctccgaagcaggctccggctccggttcagatggcctccgccgcccccacgaagccggctgctgtggcctctgctgccatgcgcaagaaggctgccatcattggtaagactgcggataccggggtgcgcaccacaaccaagggcgcacgtcgtatggccaaggcaccatccaggccgcgccctgtgatacggcctgctgtcatgccgagctcggaaatcgccatgtccaccgagccggtttccagcacggttcccgtggcgagcccggtcttgcgcaatgatgcgctgcgctctgccccgaccatggtttacactgccggtttccagcgtggtgatctgccgagcgcccgcgccaaccagttcagcggcaacgccgtcaccttcctgaccgtggcgaagttcaccgaaaccaattga

SEQ ID NO: 509 - DNA, 381 bp, Brucella melitensis
atgaaacgcttccgcatcgttgcccccctcgcactcatgtcgcttgcgctggctgcttgcgaaacaacaggcccgggcagcggcaatgccccgatcatagcccatacccctgccggcatagaaggaagctgggtcgatccgaatggcatcgcttcctcattcaatggcggcatctttgaaacccgcaccaccgacaccaacgaaaagctggcggagggcaactatctctacctgtcgccgcaactcgttgaaatcaacatgcggtccatcgtgcgcggcaccacctcgaaggtaaattgcgcactggtttcgccgacgcaacttaactgcacctcctcggccggttcgcgcttctcgctcacccgccgcaacgccggctga

SEQ ID NO: 510 - DNA, 987 bp, Brucella melitensis
atgaccggtttcgacatcacattgctcatcctggttgcactggttctggcggcattgattgccagcatcaaaaccgtgccacagggctataattatacgatcgagcgtttcgggcgttatacgcgcacgctcaatcccggacttaacctcatcgttccgttcttcgatcgcgtcggtgcgcgccttaacatgatggaacaggtgcttgatgtgccgacgcaggaagtcatcacccgcgacaatgccatcgtgggcgtggatgccgttgccttctatcaggtactgaacgcggcacaggccgcctatcaggtggcgaagctgcaatatgcgatcctgaatctcaccatgaccaatatccgcaccgtcatgggttcgatggaccttgacgagctgctttcaaaccgcgatgccatcaatgaccgccttttgcgcgtggtggatgaagcggcgcatccatggggcatcaagataacccgcgtggaaatcaaggatatcaacccgcccgcagatatcgtcacctccatggcgcgtcagatgaaggccgagcgcgacaaacgcgcgcaggttctggaagccgaggggaaccgcaacgcgcagatcctgcgcgccgaaggccagaagcaatcgcagatactcgaagccgaaggcaagctggaagcggccaagcgcgaggcggaggcgcgtgaacgccttgccgaagccgaggcaaaagccaccaccatggtttcgcaagccgtcgccaatggcaatgtgcaggcactgaactatttcgttgcgcagaaatataccgaagccctcagcaatattgccagcgccaagaaccagaaaatcgtgctgatgccgcttgaggcaagctcgctcatcggttctctgggcgggatcggggctattgcgcgcgaggttttcggcgatggttcccagcctgccggtccggctccgcaaccgcccgcccgcgcgcgtagcgttccgcccactgggcgcgactga

SEQ ID NO: 511 - DNA, 717 bp, Brucella melitensis
atgaagaagataattctcagcttcgcattcgccctgactgtaaccagcacggcgcacgcacagctcccggtgacagatgccggctccatcgcgcagaacctggccaaccatctcgaacagatggtgaagttcgcccagcagatcgagcaactgaaacagcagtttgaacaacagaaaatgcagttcgatgccctgaccggcaaccgtggccttggcgatattctccgcgaccctacgctgcgtagctatctgccacataactggcgagatctctacgaagcggtgatgagcggcggctacctggcggcggctggcgaaacggccaacctcttacgcaaaagccaggtatacgatccgtgtgcctccatctccgacaaagatcagcgcatcgcatgtgaggctaaagtggtgaagccggtccaggacaaggtcatgacgtccaaagcctacgacgccactgacaaacgcctacaagagatcgagagcttgatgcaggagatcaacaagacgggagacccgaaggcgattgccgaattgcaaggccggatcgaaagcgaaaatgccatgatccaaaacgaagacacccgccttcatctctaccagcagatggcagaggcacaggacaagctcctggacgaacgccagcacgaattagacgcgaaggataatgcccggcgcggctatccgcagccgaaagcactggaagccgcctattaa

SEQ ID NO: 512 - DNA, 720 bp, Brucella melitensis
atgtttggacgcaaacaatctccacagaaatcagtaaagaacgggcagggcaatgcgccttcggtatatgacgaagcgttgaactgggaggccgcgcacgtccggctggtcgaaaaatccgaacgccgcgcgtggaaaatcgccggggctttcggcaccattaccgtgctgctcgggatcggcatcgccgggatgttaccgctaaagcaacatgtgccctacctggtgcgcgtcaacgcacagacaggtgcgcctgatatcctgacctcgctcgacgagaagagtgtcagctacgacactgtaatggataaatactggctctcgcagtacgtgatagcgcgtgaaacctacgactggtacacgctgcaaaaggactacgaaaccgtaggcatgttgtcgtcgccgtccgaagggcagagctatgcaagccagttccagggcgataaggcgcttgacaagcaatatggctcaaatgtgcgcacatcggtaacgatcgtaagcatcgtgccgaacggcaagggcatcggcacggtgcgctttgcgaagacgacaaagcgcaccaacgagaccggtgatggcgaaacaacgcactggatcgccaccattggctaccaatacgtcaatccctctttgatgtcggaatcggcccgcctgacaaacccgctgggtttcaatgtcacgagctatcgcgttgatccagaaatgggagtggtgcaatga

SEQ ID NO: 513 - DNA, 4722 bp, Brucella melitensis
gtggtttctcacaacgtacagaacgaagcggtcaaagctgcgacgacggcttccacccgaacgacgcgaaaaaccaaggctgcgggtgttccgccggctcaaggcctttatgatccgcgcaacgagcatgatgcgtgcggcgtcggcttcatcgcccatatgaagggcaggaaatcacatgtggtcgtggaaaacggcctgaagatgctggaaaacctcacccatcgtggtgctgtcggcgccgatccgctgatgggcgacggtgcgggcattctggtgcagattccagatcgcttctttcgcgaggaaatggcgcgtcagggcatagacctgccgcagccgggtcactatggcgtcggctatattttcatgccgcgcgacccggatctgcgcgcccatgcggaagagatcgtcagggaagtgatcgccgccgaaggccagaccttcatcggcttccgcgaagtgccggtcgataattcttcgctttccaaggctccgcatatcgcggccaccgagccgttccatatgcaggtcttcatcgggcgcagcccgatgctggaaaccgacgacgatttcgagcgccgcctgttcgtgctgcgcaaggtcatctccaaccgcatctatcaggagaatgacggcgacgataagggtttctatgtcgtgtccatgtcggcccgcacggtggtctataagggcatgttcctggcctatcaggtcggcgcttattatctggacttgaaagacccccgctttgaaagcgcggtggcgctggtgcaccagcgtttttccaccaacacctttccgtcctggcgtcttgcccacccctaccgcatggtcgcccataacggcgaaatcaacacgctgcgcggcaatgtcaaccggatggcggcgcgccaggcttcggtcgatagcgaactgttcggcaacgatatttccaagctctggccaatttcctatgagggccagtcggatacggcctgtttcgacaatgcgctcgaattcctgcatcagggcggctacagccttgcacatgccatgatgatgctgatcccggaagcatggtcgggcaacaagctgatgtcggatgagcgccgcgcgttctacgaatatcatgcagcactcatggagccgtgggatggccctgccgctgtcgccttcaccgatggccgccagatcggcgcgatgctggaccgcaacggcctgcggcctgcacgctatatcgtgacggaagacgatttcgtcattctggcttcggaagcaggcgtcctgccggtcgatgaaaaaaagatcgtcaggaagtggcgtcttcagccgggccgcatgctgctgatcgacatggaagaaggccgcatcatctccgatgaggaaatcaagtcgcagatcgcgcagaagcacccttacaagcagtggcttgccaatacgcagctcattctggaagacctcaacccggtcgagccgcgtgcgctgcgcaaggatgtgagcctgctcgaccgccagcaggccttcggctatacgcaggaagataccaagttcctgatggcgccgatggcgaccacgggtcaggaagccatcggctccatgggcaccgatacgccaatttcggccatgtccgacaagtcgaagctgctttacacctatttcaagcagaacttcgcacaggtgacgaacccgccgatcgatccgatccgcgaggaactggtgatgagcctcgtctccttcattggcccgcgtccaaacatcttcgatcttgtcggcgcctcgcgccgcaagcgtctggaagtgcgccagcccatcctgaccaatggcgatctggaaaagatccgttctatcggccacacggaagaccgcttcgataccaagacgctcgacatcacctataatacgggcgagggcgcgaccggtatgcatggcgccatcgagcgtctgtgcgaccgcgcggaagcagccgttcatggcggctataacatcgtcatcctctccgaccgccaggtcgggccggaccgtattccgatcccggccctgctggcgacggctgccgtgcaccatcacctgatccgcaagggtcttcgcacctcggtcggtcttgtggtggaatcgggcgagccgcgcgaagtgcatcattttgcctgcctcgcaggctatggcgccgaagcgatcaatccctatctcgccttcgacacgctgctcgacatgcatcgccgccgcgaatttccgccggaagtcgacgagcatgaagtggtcaagcgctacatcaagtcgattggcaagggcatcctcaaggtcatgtccaagatgggtatctcgacctatcagtcctattgcggcgcgcagattttcgatgcggtcggcgtcaggacggatttcgtggacaagttcttcttcggcaccgccacgaccatcgaaggcgttggcctcgacgagatcgcggaagaaaccgtgcgccgtcacaccgatgctttcggcaatgatcccgttcttctgaacgcgctcgaagtcggcggcgaatatgcctatcgtatgcgcggcgaggcgcatatgtggtcgccggatgcggtggcaaagctgcaacatgcggtgcgcacgtccaatccagacacgttcaccgaatatacgaggatgctcgacgccaagtcgtcgcaggccaagaccattcgcggcctgttcaatatccgctttgccgaggaacgtggcctgaagcccgtttccatcgatgaggtggagccggcaacggatatcgtcaagcggttctcaaccggcgccatgtccttcggctcgatctccagagaggcgcataccacgcttgcccgcgcgatgaacgccattggcggcaagtcgaacaccggcgagggcggcgaggagccggatcgtttctacccgctgccggatggcacggcgaacccggaacgctcggcaatcaagcaggtggcctcgggccgtttcggtgtgacgacggaatatctcgtcaattccgatctgatccagatcaaggttgcgcagggcgcaaagcccggcgaaggcggccagcttccggggcacaaggtcgatgcgaccatcgccaagacccgccactccacgccgggtgttggcctcatttcgccgccgccgcaccatgacatctactcgattgaagatctggcgcagctcatctacgacctgaaaaacgtcaatccggcagccgatatttcggtcaagctggtgtcggaagtgggcgtgggcacggttgcagccggtgtcgccaaggcgcgcgccgaccatatcaccgtgtcgggctatgatggcggcacgggcgcttcaccgctcacctcgctgaagcacgccggttccccgtgggaaatcggccttgccgaaacccaccagacgctggtgctgaacgggcttcgctcccgcgtggcgcttcaggtcgatggcggcttgcgcaccgggcgcgacgtggtcatcggcgcgctgctcggggctgacgagttcggtttctcgaccgctccgctgattgcggctggctgcatcatgatgcgcaagtgccatctgaacacctgccccgtcggcgtggcgacgcaggatcccgtcttacgcaagcgtttcaagggcacgccggaacacgtcatcaacttcttcttctatctggcggaagaagtgcgcgcgcttttggcccagatgggtttcacccggctggaacagatcatcggtgaaaccgagcttctggaaaagcaggcgatgatcgaccactggaaggcgaaagggctggatttcagccgcatcttctacaagccggaggccgagaagcacgaaatctactggaccgagcgccagcaccacccgatcgacgatattctggatcgcaagctgatcgaattggccgcgcctgcgctcgaagaacgccagccggtcaagatcgacgtggagatcaagaatgtggatcgttccgcaggcgcaatgctctcgggcgaagtggccaagcgtttccgccacaagggcctgccggaagacaccatctccgtcacgcttcgcggtacggctggccagtccttcggtgccttcctcgcacgcggcatctcgtttgaactgatcggtgacggcaatgattatatcggcaagggcctttcaggtggccgcatcgtggtgcgcccgccggaagacacgcgcatcgtcgccgaggattcgatcatcgtcggcaatacggtgctctacggcgcgcttgaaggcgagtgctatttccgcggcgttgcgggcgagcgtttcgccgtgcgcaactccggtgcggttacggttgtcgaaggtgtgggcgaccacggctgcgaatatatgaccggcggcgtggttgtcgtgatcgggcagacggggcgcaatttcgcggcgggcatgtcgggcggcgtcgcctatgtgcttgatgaggaaggcgatttcgcgcagcgttgcaacatggcgatggtcgagctggagccggtgccggaagaagacgacattctggaaaagctgcatcaccatggcggcgatctcatgcacaagggccgtgtggacgtttccgccaacatgacccatcatgatgaggagcgtctggtgcagctaatcgccaaccacctgcactatacgggttcgacgcgcgcaaaagacattctcgacaattgggaaagctatcgcccgaaattcgtgaaggtcatgccggtggaatatcgccgcgctctggaagagatggagcgcatgcagatcggcgtggcggctgagtaa

SEQ ID NO: 514 - DNA, 315 bp, Brucella melitensis
atggcgcccaagttcaacaggagtttcgttatgaccatcaagcacaacatcatcgccttttccgccctcgccctgattgcaggtttctcgcttacgccagccgctttcgccgaagatgcgatgaaaaccgaccatatgaagtcggacgcgatgaagagcgataatatgtcaaaggatgccatgggcaaggaagatgccatgaagggcgatgccatgcacaaggattccaagaaaatgaagaagcacgacgccatgaaaggcgatgcgatgaaaggcgacgccatgaaaggtgacgcaatgaagagcggtcagtaa

SEQ ID NO: 515 - DNA, 786 bp, Brucella melitensis
ttgatgagcaccattggcaaagctctgacgcttctggatgtcctgtcgcggctgaataccgaggcgggattgaccgagattgcgcaggcctgcggatatgacaaggcgacgacccgccgttttctggtcgatctggaaaagcacggcttcgtcgagcaactggccgaaagccggaaataccgaatcggggccgagccgctgcggctcgcgcgcattcgcgaagcccgctatccctttctgggcacggcccttccattcgtaaggcagcttgccgagcgaaccggcgaaaccgtgcatctttccgaattttccaacgggcggctttccaccattcatgtggaagaatcaccccgcgcccatcgggttttcatcaatgtcggcatgatcctgcctttccacgccacggcatcgggcctcgcctatctggcagcctgtgcggacgatgtggtggaggccacggtgacgaaatcgctcgatacattcacggaatttacgatcgctgacccggaggaagtccggcggcgcgtgcgcgaagcacggcaaaacggcttttccgttaaccggcaggggctggaagtgggcgtgatgagcacatcggcggcgatcctcacacccggatcgagaccggttggctgcattacggtggccgcaccccttgcgcgtgccgatgacgggatcgtcatgcgatatggcgcggacgcccatgccacggctgaggctatttccgctgccctgttcgcagaacacaggcaagcccgttccaatcaatcgaagaggaacggttga

SEQ ID NO: 516 - DNA, 681 bp, Brucella melitensis
atgagcgcgctttccatcagccgatatctgactgacttctcgacccaccatattgacgataaggcggttgagatcattaccgcgccggttccgccaaaaccgctgacacccgtagcgggcgaggctgcggaaaagcctgccgcagtggggcaggagcaggcggaaatggccgcagtgatcgcgctggaggaagaaaaacgcgcggctttcgaggctggccgtgaagatggccacagggaagcacaggtgctttacgaggctgaaaaggcgcgtctcctgcgtgaacatgaagcggaaatcgagacgctgcgtgccacattttcgcgcgaacaggctttgttgctggcgggtagccttaccgaagcactgagcgcgctggaacagagcctctccggccagatggctgaaatactgatgccacttctggccgcgaaaatggagcatgaggcggtagcggaatttgcccgtcgcatcgcggcactggcgctggaaggtgaggcgccggaaatctccggcccggcccggcttctggaagcattgcaggcccatggggtgcttttgccctccggttgccgcttttcagagacggcatcgaacgaactttccttttcctttggcgaacggatgctcgaaacgcgcatcgcgccgcttcttgaagaactgaaggctgcggtgaaatga

SEQ ID NO: 517 - DNA, 1101 bp, Brucella melitensis
atgaacattgagcccgaaacgaagcgcgagatcatcattgttcgccggggcgggcatgacgaccatgaggcgcatcatggcggggtgtggaagattgcctatgccgacttcatgacggcgatgatggcttttttcctggtcatgtggctcatcaatgctgccaatgaggagaccaaggcggcggtggcgagctatttcaatcccgtcaagcttatagaccgccattccagcccgaagggcgtgcaaaatgtggaccagcgcgatggcaaggttcgttttgaaagcgaccagcaggtggaaagtagcaccaaggtcgtcaacgacaccactgtgcgcccggcaagcgaccaggaggagcggcagctcttccgcgagccctatgccatgcttgcggaattggcgcatgaaacaggcgttctgcaaaatcagtcggcaaagggcgatggcggcacggcgcaatccggctccgccagcggtgcggatggcggcgaggcctatcgggatcctttcagcccggattactggtcgagcaaggcggtgggagacctgaccccgcctgcgccgcaaaccgtgccgcaaactgcacccttgccgcaggcgcagcccaaaaaggctgaaacgcaggaagaactgatcgccgatctgaagaaagccgcaacaggtgaaccggccccgaacgcgggcaaggccgccaaacccgaaccgatgccggatgttaccgtggttcccgtggaagggggcgtgatgagccagcttaccgacaaggttgattatggcatgttcacgatcggctccgccaagccggatgcccgtgtggtgcagatgctggagcgcattgcgcaggtgattgcccgccagccgggcgaggtcatcatcagcggtcatacggatgcgcgcccgttcaaaagcgcgacctatgacaattggcggctatcctcggcccgtgcccagatggcctattatatgctggtgcgcggtggccttgatgaaaagcgcgtgttgcgtgtcgagggctacgcagaccgccagccgaagaaccccaacgatccgaatgccgcggaaaaccgccgcatcgatattttcatcaagtccaagccatga

SEQ ID NO: 518 - DNA, 1620 bp, Brucella melitensis
atgctattcaagacaacgggaacaaggtctggatcattgaaaacattgcgaagcctgatgatggcggcaaccttgctgacggcattctcggggattgcctcggcacaaagtgccaattcactggttatcgcgcgaaatatggatatcaactcgctcgatccgcaccggaccttctgcgatacctgccagatctacgattctgccgtctatgagggtttgctttcgctggataaggacaacaaggttgtgccagtgcttgccgaaagctatgcagccaatggcgaccagaccgagtttacgttcaaaatcaatccaaaggccgtattctcggatggttcacgggtggaagcaaaagacgtcaaatggtcgtgggaacggcttaaaaacgtcaagggcagcccgtcgttcctggccgatactattgcttcgatagaaacgcccgacgaagcaacagtcgtggtcaaaacccgggcaccgaattctgaattcttcaatgttgtagcctcgccttatttcggtatcgtgaacagcgatgtggccacgaccgaggctaaggcggaaaatggggcggacgcagcggagaaagataatgcggaagcgtggtttctcgcgcattcggctggcagcggtcccttcgtcctcagcgcttatgagccaaattctgaactgcgtctaaagcgaaacgaaaaatactggcgggaagcgccgaaggtggatgaggtcatcttccgccaagtgaaggacgctgtggcacaggcacaaatgctggagaatggcactgcagacatcgcgatgcagattgatcccgagacggccaagacattccgtaacaaggacatcaaggtcgattccatccattcctacaacttcatctatctggcgctttcgccgggtgcaaaatcgaacgccgtgccgctgactgcagacattcgagaggccatttctattgcgatcgaccgtgaatcgctgctcgacttcatgcttggagacaaaggtcagttgatcggaacggcaattccgataggttttccgggcggaacggggcataaaattcccgaatataatcccgaaaaagccaaggagctgcttgccaaggccggtcatcctaatggtttcacgctggaagccgtttatccgaacctgaacgtctatggcgtagatttcacccagatgatgcaaaagatccagcaggatctttctcagatcaatgtcaaggtcgagctgcagccggtgccgtttgcaagctggcgtgaaaaggctaatggcgacggaatcccgatgacagccgtttattacgcgccggatttcttcggcacatcccagtatgtggatgcatttggattggcgaagggcagtctctgggcaaaacgcgccggggaggctcgcgatccatcattcgtaaagactgaaattccgcagatcatggcagatgccctcagagcaccgctagatgaggcggacaaggtctggttcaaggcgggcgaggccatggccgcgtcgaatgtcatcattccgatgctgagcccagacgttattctggcatataacaacagggtgaacggcgtgcgctattccgcctgctgcaatctgccattgcaggagctttccgtatccagatag

SEQ ID NO: 519 - DNA, 837 bp, Brucella melitensis
atgtcgtcagtcctttcccgctatgcgcttacccgtcgcgcgggcctgaaagcccttctcttcaccgctgcggccctcaccgtcggctttgcatccgctcccagccatgcagaagacaagaccatcaaggtcggcatcatgggcggcgaggacgaagatgtctggaaagtcgttgctgaagaaggcaagaagcatggcctcaatatcgagcgcatcaccttcaacgattataaccagccgaacgaagccctggagcgcaaggaaatcgacgccaacgcattccagcacaagccctatctggacgagcagatcaagcagcacggctacaagatcagcgttgcaggctataccgcagtctggccgatcggcatttattcccgcaaggtgaagaagcttgaggaactgaaggacggcgccaccgttggcgtgccaaacgacccgaccaatgaaggccgtgcgctgcgcgtgctggaagaacagggcctcatcaagctgaagccggatgcgggcattctggcgacgccaatcgacatcgttgaaaacccgaagaagcttgaaatcaaggaactggacgccggcgtcgtcggccgctccatcgatgatcttgacgcggcaatcgtcaacaatgactgggctgcgaaagccgggctgaaaaaagaggatgccattggctgggaatcgaaggaaaacaatccctacaacaatttcatcgccgttcgcaccgatgatctcgaccagccttgggtgaaggcactggttgcctcattccagaacgacgccgtgaaggccgaacttgagcgcgcctacaagggcaccggcatcccggcctggaattaa

SEQ ID NO: 520 - DNA, 1095 bp, Brucella melitensis
atgaaccccatgttccgtgctgccggttgcgcggtcctgtttggcgcgctgacggtgcttgccgcttgcggcaaagaggatgaaaaggcgcaggaagctgcgcccatccgcccggttctctatacgatcgtggagccgaagcctgtcgcccagacgggttttgcgggcacagtcgagccgcgctattcgaccgatctggctttccgcgttctggggcgggtcatagcccggcctgtgaaggtgggcgatctcgtgaagaagggcgagatggtggcaatgctcgatccatcggcgcttgatcttgcggtgcaatcggcaagggccgaccttgccagtgccgaggcacaatatgccaatgcttcggcaagcgaggaacgccagcgtatcctgctgcgtggcaacaatgtttcgcaggccgattatgacgcggccaggcaggcgcgcgacagcgccgaggcagggctggaaaaggcgcaggccggtttgcgcaaggccgaagaccagcggggatatgccgtgctgcgtcccgatttcgatggcgtgatctccgcaacggctgccgaagtcgggcaggtggtttcggcgggtcaggcgatcgtgaccgtggcgcgtcccgatgtccgggaagcggtggtggatattcccgacagcatgaccgaatatttcaagcccggcactcctttcaatgtgcagcttcaggccgatccttccgtgaaaggaacgggaagcgtgcgcgaggtcgcgccgcaggccgatgcacaaacgcgcacacgccgggtgcgcatcgcacttgacaatccgcccgaagggttccgcctcggcgcaaccattcaggccgctcgttccacgccggaaacgggcttcgtttccctgcccatgccgtcgcttctcgaacaggacggcaagaccagtatatgggtgatcgatcccggaacacagaccgtgagccttcacgatgtgcgcgttatcgagcgcaagggagcaagttttgtggcaggcggggtcgaggccggcagctatgtggcaattgccggtgtgcatgaactgaaagcagggcagaaagtccgtctggacgagaaaggaagcgggctgtga

SEQ ID NO: 521 - DNA, 207 bp, Brucella melitensis
atgaaattataccgtttcatcaccgggccggacgattccgctttctgtcatcgtgtgacggcggcgctgaacaagggctggcagctttatggctcgcccacctatgccttcaatgccgcaactggcgtcatgcattgcggccagccggtggtgaaggaagttgatggcgtcgattacacgccggatatcaagctcggcgaatattga

SEQ ID NO: 522 - DNA, 1398 bp, Brucella melitensis
atgaccggacttaagcccgacaacaacttctttgcggaagtgctcaacgttgccgacctccctgctgccgccattgcaagccgcatcacggatatgcgcaccggcgacgcagttgaaatcgtcaacgaactggatgccgatgatgcagtcgccgtcattgcccagctttcgcacgacgacgccatccgcctgctggaccagccggaactgcatcgcgcggccgaaatcgtcgcagcgctccagcccggtctcgcaagcctcctgctcgacggtatgtcggccgaccgcgccactgacgtttttcaggaactcgaagacgtcgaccgcgcccgtctgtttcccattctcgcgcctgaaacgaaggctgcgctgaaaaagctgatgggctatccgccgaatacggcagggtcgctcatgaccatcgaattcatcgctgtgccttccaactggactgtcggccagacgctggaccatatccgcaaggtcgagcgcacccgcgagacggtttatgcgatctatgtcgtcgatccgttgagccgcgtcctgttgggcgtggtcagcctgcgccgcctcatcatccgccagccggatgagccgatcctgtcgatcgcccgtgatgacgagccgatcaccatttcgccgctggcaagccgcgaggaagtggcgcggcttttccgcaagcacgaccttctggccgtgccggtggtggatgaaggccgtcatatcattggcatcgtgacggtcgatgatgtgctggacgccatgacggaagaggcaagcgcggacgcttatcggtttggcggcatggaggcgctggacaagccctatatgcgtatcggtttcggcgaaatgctgaaaaagcgcgccggctggctcggcattctgttccttggcgaaatgttgacggcaagcgccatgcagcatttcgaggcggaactggaaaaagccctggtgctcaccctgttcattccgcttatcatgtcttcgggcggcaattccggttcgcaggccacgtcgctcatcatccgcgcgctggctttgcaggaaatcaagcttaaggactggtggcgggttgcgttgcgcgaaataccttccggtcttgcacttggcggttttctgggcttcatcggcattattcgcatcaccacatggcagacgctcggtatttacgactatggcgaacactggattctggtggcgtttacggtcggcatggcgctcgtcagcattgtgacattcggctcgctgaccggctcaatgctgccttttgtgctgcaaaggctgggctttgatcctgcaagcgcgtctgcgcctttcgtggcgacattggtggatgtgacgggcctcgtgatctatttcagcgttgcgctggtcattctgtcgggcacgcttttataa

SEQ ID NO: 523 - DNA, 1023 bp, Brucella melitensis
ttggaaagtatcgagcgcgccatcagaaacgcatttgccaaggcagatgcacataatccggcgacccgtcagcgaatctatgaatcggcctggggcgcccatgagcgcgccatggcgaccaacacggcgctgagcgccgcgcaaaaggaacagcgccgcgaaaaactgaaagacgccatttcccgcattgaggaggaattcgcgaagcggcatcaagatggtgaagcgcagcgcgaaccctcgctggattcgccgcaccagaacgatcctgttctcggctcaagcatggcagaaagcacgcccgtactggacagcggcgatattcgcccaatgtcgagaaagaagcggcccgccgccgaccttggctacgagggtggcacctcgcggaaggatcacaagaaaaagcggcattcgcctttttacagctatggcatcccggcactcgtgttgctggttgccgtgatgatcggctattcgctttataacagcctgtccgatctggggcgcggtccatcgaccgggccgctgatgagcggtaccagccttgcgcctttgaaggaaggtgaagagccgggcggggcaaagtggatcaatatctttcttcccgacgaggccacgcgcatatcggttcagggcagtgcgacagcggaaatcctgcaagatggcaagaacaaatttgcccgcatccgctcctccggtgtgggtgacactgtcactttcgatgtcggcgaaggcattctcgaccagcttgtcggcaagaaggcaaccttcgatatcatcgcacgcagcgatgatggcaagcttacgcaaatgtcggtcaattgcaacctggcgggcctcggagattgtgggcgcaggcgctatgacgtgaatgaatcgctgaatgattttctgttcgatatggatttttccgcgagcagaaagccaggcggcgcaggtacgattaccgtcgattccgatctgagcaacagcggcaagccggtcgatatatatgcgatccgggtgactacggctgacaaataa

SEQ ID NO: 524 - DNA, 2556 bp, Brucella melitensis
gtgacactgacccgcaagcccatcgcagcatctgccacctttcttctgccggaccgtttcgtcaaatggtttgcggccaagggttggtcgccgcgtgcgcaccagctggagcttctggcgcgcgccgaacagggacagtccacgcttctgatcgcacccaccggcgcgggcaagacgctggccgggtttctgcccgcgctggttgatctggaaaagcggcgaagcaaagcaatttcaggaaaagtgggaaccggttttccgtccggaattgcgccaaaatcaaaaagtggcgttcacacgctctatatctcgccgctgaaggcgcttgctgtcgatattcgccgcaatctcactgtgccggtggaggaaatggggcttgatatttccatcgagacccgcaccggcgacacacctgcccacaagcgtcagcgccagaaactggcgccgccggatattctgctgaccacgccggagcagcttgcacttttgatcgcgtccagggtggcggagcaatttttcaaagatttgcgctatgtggtgctggatgaactgcactcgctggtgatttccaagcgcgggcatttgctggcgctggggctggcacggctgcgccgcctgcaaccacagttgcagaccatcggtctttccgccaccgtggcggagccggatgagttgcgccgctggctggtggagcaggatgggaccgggtcgatggccggtcttgtcaccgtcgatggcggggcaaaaccggaaattaccattctcgattctaaggagcgggtgccatgggcggggcactcctcacgctatgccattcccgatatttacgcggcgatccgccagcaccgaacgacgcttttgttcgttaatacgcgcagtcaggcggagatgctttttcaggagctctggcgggtcaatgaggagacgttgccgattgcgctgcatcacggctcgctcgatgccggccagcgccgcaaagtggaacaggccatggccgccaatacattgcgggcggtggtcgcgacctcgacgcttgatctcggcatcgattggggcgatgtcgatctggtcatccatgtcggcgcgccgaagggcgcaagccgccttgcgcagcgcatcgggcgcgccaatcaccgcatggacgagccaagccgcgccattctggtgcccgccaatcgcttcgaggtgatggagtgtcgtgccgcgcttgatgccaattatctgggcgcgcaggatacgccgcccttgatcgacggggcgctggatgtgctggcgcagcatgtgctgggcatggcctgtgccgagccgttcaacgccgatcagctttatcgtgaggtgcaaagtgcggccccttatgcaaaccttccgcgagacaccttcgaccgcattctcgattttgtggcgaccggcggctatgcgctcaagacctatgagcggtttgcgaaaatccgcaagacggtggacggcacgtggcgggtgtccaatccgcgcatcgcgcagcaatatcgcctcaatatcggcaccattgtcgaagcgccggaactgaatgtgcggctcacgcgcggcggcaagggcgcgaatgcgcggggcgggcgcgtgctgggccgcatcgaggaatattttctggaaacactaacggctggcgataccttccttttcgccggaaaggtgctgcgctttgagggtattcgggaaaatgaatgcatcgcctccaatgctgccgggcaggacgcaaaaattcccgtctatgcgggcggcaaatttccgctttccacctatctcgccgcgcaggtgcgcgccatgcttgccgaccgcgcgcgctggcaattcctgccgcagcaggtgcgcgaatggctggaggtgcagcaatggaaatccgtgctgcccggcacggacgaacttttgatcgaaaccttcccgcgcggcaaccgcttctacatggtggcctatccgtttgagggcaggctggcgcatcagacgctcggcatgttgctgacgcgccgtctggagcgcatgggcgcgcatccgctgggctttgtcaccactgattattcgctgggtctctggggcctcaaggatatggcgtccatgatccgcatgggcaggcttaacctttcgcgcctgttcgatgaagacatgttgggcgacgatctggaagcgtggctggatgaaagctatcttctcaagcgcacgttccgtaattgcgccgtgatttccgggcttatcgagcgccgtcatccggggcaggaaaagaccgggcgtcaggtgacggtttcgacggatcttatctacgacgttctgcgcagccacgagccggaccacattctcttgcaggccacacgcgcggatgcggcaacggggcttttggacatcaagcggcttggcgacatgctggcgcgtgtgaaagggcatatcctgcacaagccgcttgaccagatttcgccgctggcgctgccggtgatgctcgaaatcgggcgcgagcgcgtggcgggcgagggcgatgaaatgctgcttgaagaagcagccgacgatcttgtcagggaagcaatgcaatga

SEQ ID NO: 525 - DNA, 1581 bp, Brucella melitensis
atgttgacggataggttgcgcgggctgatactcgcatttgcttttgtttctgtagcgtttgtttccggcgctcatgcagatccaaagctgaatttttcctggccggtgaatgtagggccgctcaatccgcacctttattctccgaaccagatgtttgcccagaacatggtttacgagccgctggttcattataatgctgacggcaccgttggcccctggctggcagaatcctgggaagcgtttcaggatggccgatcctacacattcaagcttcgggaggacgtcaagttctcgaatggcgaggttttcgatgcggctgcggtcaaggcaaatattgataccgtattgcaaaaccgcccacgtcataactggctcgaacttgttaaccagatggtctctgccgaggttgtcggtccttacaaggtgcggattaatctcaaaaaaccttattacccgttattgcaggagctttccctgccgcgccccttccgcttcattgccccgtcgcagttcaaaaatggcggcaccgcagatggcattgtggcgccgattggtacgggtccgtggaaattgaccgagaccaaacttggcgagcacgacgtatttacccgcaatgatagctactggggtcccaagcctgcttatgagcagataactgtcaaggtgatacccgatccgaatacacgggcgattgccttcgaggctggcgaaatagacctgatctatggaacggaagggccgatttcccccgatactttcgagcgcttccagaaaatgggcatctataatactgagctttcggagccgttagaaacgtgcgttttggcgatcaacaccaatcacggcgcaacaaaagacctcgctgtccgcaaggccatcaatcatgcagtcgataaggacacgatgattgccaccgtgctctacgggacacagaagcgtgcagataccctgtttgccgataatgttccctacgccaatatcggcctgaagccttatgctttcgacccggctctggctgcccggcttctggatgaagccggatggacagccaaggcaagcggcgatatccgggagaaggatgggcagcctctggcgatcgagttgtgcttcatcggcacggatgcgatcagcaaatcgatggccgagatcgtgcaggcggatctgcgtaaggtcggtatcgatgtcaagctgacgggcgaggaggaaagcagcatctatgctcgccagcgcgatggtcgtttcgatatgattttcaaccagacctggggtgcgccctacgatccgcacgcttttgtcagctccatgcgcgttccctcccatgccgattatcaggcgcagctcggcctgccggacaaggcgaaaatcgatgcggagatcggtcaggttcttgtctcgactgatgagacggcaaggcaggcgctttacaaggatatcctgacccgtcttcacgaggaagcggtttaccttccgctcacctctgtcaccgcgatggcggttgcgaaacctgaggtcggcaaaatcacattcggagcgatgtcgagcgagatcccctttgagaaactgaccccgaaggcgaactga

SEQ ID NO: 526 - DNA, 2217 bp, Brucella melitensis
atggcttatgtaaatttcaaggttgaaaccgacgccgacggcattgctctcgttacatgggacatgcccgaaaagtcgatgaatgtcttcaccgtcgatgcgatgcaggaactgaatgcaatcatcgatgcggtgatagctgacgacaagatcaagggtgttgtcatcacctccggcaaggaaaccttctccggcggtgccgacctgaccatgctggaaggcatgttcaaggaattccagaagcagaaggtcaaggaccccgaaggcgcggtccagaccctgttcgacaatgtcggcaagatgagcggcctgttccgtaagcttgaaacctgcggcaaaccgtgggtttcggccatcaacggcacctgcatgggcggcgcatttgaaatgtcgctcgcctgccatgcgcgtgcggcgtccgatgcgccgggcgtgaagatggccctgccggaagtgaaggtcggccttttccccggtgctggcggcacgcagcgcgttccgcgccttgccaaccagcaggacgcgcttcagatgatgacgacgggttcaagcctcaccgcgcagcgcgccaaggctatgggccttgtcaccgagattgctccggccaagaagctggtcgaaacagccaagaagctcatcaagggtggcctcaagccggttcagccctgggatgaaaagggcttcaagctgccgggcggcgcgatttattcggctgccggtgcaaacctctggcctgccgcgaccgccatcctgcgtcgcgaaacatcgggtaattatccggcggcactcgccattttgaagtcggtttatgagggccttctggtgcctttcgacaccggcctcaagattgaacagcgctatttcaccgaaatcctccagacgaccgaagcgggcatgatgatccgctcgctcttcgtgtcgttgcaggagttgaacaagggtgcgcgccgtccggttgacgaaaagccgaccaggctcaagaagatcggcgtcatcggcgcgggcttcatgggtgcaggcattgcctatgtgacggcgaaggccggtattccggtcgtgctgatcgaccgcgatcaggaatctgccgacaagggcaaggcccacacggcagacctaatcaccaaggaaatgcagaagggccgtgccaccgaggccgacaaggaaaaacttctgtcgctcatcacagcaacgccggattatgcccagcttgaaggtgctgatctggtgattgaagccgtgttcgaggaccgcgaagtcaagcgcgttgcgaccgagaaggccgaggaagtgctgaaatcttccgcagtcttcgcctccaacacctcgaccctgccgatcaccggtcttgccaaagtgtcgaagcgtccgaagaattttatcggcatccacttcttctcgcctgtcgacaagatgatgctggtggaagtgatcctcggcaagaagacctctgacaaggcattggccgtagcactcgattatgtccgtgcgatcaagaagacgccgatcgtcgtcaacgatacgcgcggcttctacgtcaaccgttgcgtgctgcgctatatgtcggaagcctacaacatgcttgttgaaggcgtcccggcggcgatgatcgaaaatgccgcccgcatggccggtatgccggtcggcccgcttgcgctcaacgacgaaacggccatcgacctgtcgcagaagatcctgaaagccacgcttgccgatcttggtccgaaggccgttgacccgcgccatgtggaattggtggacaagcttgtcaacgagttcgaccgcaagggccgcaagaatggcaagggcttctacgattatccggcaaagcctgccaagaagcatttgtggccgggtctgaaagacctctatccgcagcagaacccggacaagatcgatgtgaaggagcttaaagagcgcttcctcgtcaccatcgctctggaagctgcccgcgtgatggaagaaggcattgtgaccgatccgcgtgaagccgatgtcggctccatcctcgccttcggtttcgcgccttatacgggcggcacgctctcctatatcgacggtatgggcgcgaagaaattcgtccagctcgccaaggatttgcagaagaaatatggcgcacagttcaaggcgccgaagcttctgctcgatatggccgagaacggcgaaaccttctaccagcgtttcaatccctataagggcgaaacgaaaaaagcagcctga

SEQ ID NO: 527 - DNA, 3657 bp, Brucella melitensis
gtggccgttttccagaattttgcgccgccgatccgcgagcaaagcgcactgaggcaagcgatcactgccgcttatcgccgccccgaagccgaatgcgtttcagcgctggccgagcaggcaaccttgccggaggagacgcgccagcaaatccgttccaccgcccgcaagctgatcgaagcgctgcgtgccaagcataagggcaccggcatcgaaggtctggtgcatgaatattcgctgtcgagccaggaaggcgtggcgctgatgtgccttgccgaagccttgctgcgcattcccgatatggcgacgcgcgatgcgctgatccgcgacaagatatcgaatggcgactggaaatcccacattggcggcgggcgctcgcttttcgtcaatgctgcgacatggggcctggtcgttaccggcaagctcaccaataccgtcaatgatcgtggcctttccgccgctcttacccgcctcatcgcccgctgcggcgagccggtcatccgtcgcggcgtggacatggccatgcgcatgatgggcgagcagttcgtcaccggcgaaaccatcgatgaggcgttgaaacgcgccaaggagctggaagagcgcggcttccgctattcctacgacatgctgggcgaggccgcgaccaccgccgccgatgcagagcgttattataaggattatgaaaccgcgatccacgccatcggtcgtgcttccgcagggcgcggcatttatgatggtcccggcatttccatcaagctttcggcgcttcacccgcgttatacccgcgcgcaaagtgagcgcgtcatgggtgaacttctgccgaaggtgaaggcactcgcggccatcgccaagtcctataatatcggcctcaatatcgacgcggaggaggccgaccgtcttgaactgtcgctcgacctgttgcaaagcctttgcgaagaccctgatctggcaggctgggatggcatcggcttcgtggtgcaggcctatggcaagcgctgccccctcgtgcttgatttcatcatcgatctggctcgccgcaccaagcgccgcgtcatggtgcgtctggtgaagggcgcctattgggatgcggagatcaagcgtgcgcaggtggatgggctggaggattttccggtctatacccgcaaggtgcatacggacgtttcctatattgcctgcgcgcgcaagcttctggccgcgacggatgtgatctttccgcaatttgcgacccataacgcgcagacactcgccacgatctatcatctggccgggccggatttcaaaaccggtaagtttgagttccaatgcctgcacggcatgggtgagccgctttatgatgaagtcgtcggccccgaaaagctcggtcgcccggcccgcatttatgcaccggtcggcacgcatgaaacgctgctcgcctatctcgtccgccgccttcttgaaaacggcgcgaactcctccttcgtcaaccgtattggcgacaaaaacgtctcggtcgatgagctgatcgccgatccggtggaagtcgtccggtcgatggctgtcgtcggtgcgcgtcatgaccagattgcgctgccggaaaatctctatggcgcgcgccgcaattccgcaggctttgatctttccaatgaggtgacgcttgcggaactgagcaaaaccttgaaggaaacggcaggccgtgcatggaccgccgaaccgcaggtggcgggtgcaaaggtgaagggcgtaagccgtccggttctcaatcccggcgaccggaatgatgttgtcggcaccgtaacggaaatcgcagaggccgatgtggcaaaggcgatgaaggcagcgcaaaccgcgaccacaagctggtccgcggttgcgcccgcagaacgcgccgcctgtctggagcgcgcagccgatatcatgcagcgcgacatgccggctctgctcggcctcgtcatgcgcgaggcgggcaagtccatgccgaacgccattgccgaagtgcgtgaagccatcgatttcctgcgctattatgccgaacagacccgccgcacgcttggcgtcggccacaaggcgcttggccctgtcgtctgcatcagcccgtggaacttcccgctggcaatcttcaccggccagattgcggctgcacttgttgcaggcaatccggttctggcaaagcctgccgaggaaaccccgctgatcgccgctgagggcgtgcgcattctgcatgaggggggcattccggcggatgcgctccagcttctgccgggtgatggccgcattggcgccgcgctggttgcagcaccggaaacttgcggcgtaatgttcaccggctccaccgaggtggcgcggctcatccaggcgcagcttgcctcgcgcctgctgccgaacggaaagccggtcccgctcattgccgaaacgggcggtcagaacgccatgatcgtggattcctcggcacttgccgagcaggtggtgtttgatgtcatcgcttcggctttcgatagcgccggccagcgctgttcggcgctgcgtgtcctctgcttgcaggaagatgtggccgaccgcattctcaccatgctcaagggcgccttgcgtgagctttccattggccgcacggaccagctcaaggtcgatatcggcccggttatcaccgatgaggcgaagaacaccattgaaaagcatattcaggccatgcgcgatcttggccgcaaggtggaacagcttccccttggcccggaaacgcagaacggcacttttgttgcgccgacaatcatcgagattgaatcgctgcgcgatctcaagcgcgaagtgttcggcccggtcctgcatgtggttcgttacaagcgcgacgacatggaaagcctgatcgatgatatcaattcgaccggctatgggcttacttttggtttgcatacgcgccttgacgagacgattgccaatgttgcggatcgcatccgtgtcggcaatatctatatcaatcgcaacattatcggcgcagtggtgggcgtgcagcctttcggcgggcgtggcctttccggcaccggcccgaaggcgggcggtccgctctatcttggccgtctggtcgaaaccgcgccgatcccgccgcgtcacgcttcggttcataccgatgcggcgctgaaggactttgcccggtggctcggcaatcgcggcatgaacgatctggcgcaggcggcgcgcgataccggcagtgcttcggcgctcggtctcgaactcgaactgccgggcccggttggcgagcgcaatctctatgctctccacccgcgcgggcgcgtgcttctggtcccccagaccgaaattggcctctatcgccaattgacggcggtgctggcaaccggcaacactgcggtcatcgacgaggcttgcggtttgcgcgccgtgttgaaggatctgccggaaacagttgccgcgcgcgccatctggacgggcgactggcaggcggatgcgccttttgccggagcacttatcgaaggcgacagcgcgcgcatcaaggaggtgaactccaggatcgccgccctgccgggaccgctcgtactcacacaggcggcatcgccggaagatcttgcagccaatcaggatgcttattgcctcaactggctgcttgaggaagtctcgacctccatcaacaccacggcagcaggcggcaacgccagcctgatggcgatcggctga

SEQ ID NO: 528 - DNA, 1890 bp, Brucella melitensis
ttgcgacgtgtgggacaaggcgcacgcttactgaacactttccctcgggggaaggatggaggaaatatgaaaaccgttcgactgaccgccgcgcaggcactggtgcgctatctggccaaccagatgacgccggagggcgacacattcatcgcgggcgtctgggccattttcgggcacggcaatgtggcggggctgggcgaggcgctctaccgcgctcgcgagcatatgcccacctggcgcggccataacgagcagaccatggcccatgcggccatcgcctataccaagcagcttggccgcaggcgcgcctgcgccgtcacctcctccatcggccccggcgcaaccaatatggtgacagcggcagcacttgcccatgtgaaccgcctgcccgttctgttcgttccgggcgatgtcttcgccaatcgcggtcccgatccagttctccagcagatcgaggatttcaacgacggcaccatgaccgtcaacgactgtttccgcccggtaagccgttatttcgaccgtatcacccggccggaacagcttctcaccgccctgcctcgcgcctttcgcaccatgaccgacccagccgattgcggcccggtgacgctcgccttctgtcaggatgtgcaggcgcaagcctatgactggccggaagaattcttcacgcccaaggtctggcactggcgccgcccgccgccggacgagcgggaactggaaaccgctgccgccgccatcaaaaccgcgctgaagcccgtcattgtggcgggcggcggcgtgcattattccggcgcgcatgaggtgctgcgcgcttttgtagaaacacatggcatccccgttattgaaacacaggcgggcaaatccgcactgccatgggaccatccgctgaatttcggtcctgtcggcgtgaccggcgctgacagcgccaatgcggttgcggcagaagccgatctggtgatcggtgtcggcacacgctttcaggacttcaccaccggctcatgggccctgttcaggcatccggggcgcaggcttctttcgctcaatgtacagccctatgacggagccaagcataattctctgccgctggtagcagatgcgaagattgggcttgaggcactctccggggccattggcgcttacagacgccaggccgtcgatgccagcctcaaaaacagatggtttgccgctgccgaccgtttcaccgccgcgcccagcgacggcaatgcgctaccgaccgacatgcaggttatcggtgcggtgcagcggcaagcgcgcgaaaattccgttgtcatgtgcgcggcaggcaccatgccgggtgagttgcatcagctctggaaggccgggcgccccatgtcctaccacatggaatatggcttttcctgcatgggctatgagattgccggcggccttggcatcaagatggccgaaccggaccgcgacgtcatcgtgatggtgggcgacggttcctatatgatggccaattcggaactggccaccagcatcatgatggggcagaaaatcaccgtcgtcgtgaccgacaatcgcggtttcggctgcatcagccggctgcaaatggcgaccggcggcgcggaattcaacaatctgctcgaccatgccgcccatgtgaacccgtcgcagatcgattttgccgcgcacgccgccgccatgggtgcggatgcgaaaaaggtcggctccatccgcgaactggagggcgcactggccgaagcacgcgacagcctgcgcacgaccgtcattgttatcgacaccgacccttaccccacgccggaaaccggcggctggtggtgggatgtcgccgtaccggaagtctcggaacgcgatgaggtgcgcgccgcacgcaaaaactatgaagcccagatcaaagaaagaaactga

SEQ ID NO: 529 - DNA, 774 bp, Brucella melitensis
atgaaattcgctcagattctcgcaaccgcaggcatcattcaggcagttcttttcaccggcgcaatggcgggtgaaaatctcgatgccatcaaatcggccggtgtcctgaaaatcggcaccgaaggcacctatgcccccttcacctatcacgacaaggacaacaagcttgttggcttcgacgtggagattggtgaagccatcgccggaaagctcggtgtgaagccggaattcgtggaaggcaaatgggatggcctcattgccggcctcgacgccaaccgctacgacgccgtcatcaatcaggtcggcatcacagaggaacggaagaagaagttcaacttctccaatccctatatcgtttccaaggttgttctcatcgtcaacgataagaatgacacgatcaaggatttcgccgatctgaagggcaagaaggcagcccagtccctcaccagcaattatggccgcctggccaaggaagcaggtgcgaaactggttgcgaccgacggcttcgaccagtcgatccagcttgtccggacaggccgtgccgatgccacgctcaatgacagcctgtcctatctcgacttcaggaagcaccagcccaaggctcccgtcaaggtcgtggcggaaaaggacgaagccaccgcctctggcatcatcgtgcgcaagggcgacgacgagctggtcgccgccatcaacaaggcgctcgatgaaatcaaggccgatggaacctacaacaagatctcgcaaaaatatttcggccaggacgtttccaagtaa

SEQ ID NO: 530 - DNA, 771 bp, Brucella melitensis
atgcgagaaacagattttgtcggaggctttgccaagggattgcgggtcatagaggctttcggagaagacaggccgcgcctgtcgattgccgatgtctcaaaaatcacagggcttgaccgtgctaccgcgcggcgctgccttctgaccctcgcagagcttggctatgccgaatatgatggcaaattcttcatgctgctgccgcgcattctgcggctcggccatgcttatctttccggcacgccgctgccgacaatcatccagccgcacctcgaccgcctttcgcaaagcgtgggagaaagcgcctccgcttccgtgctcgacggggcggagattgtttatatcgcgcgtgcttcgcaaatgcgcgtcatctcgatcaatctcatggcaggaagccgtctgcccgcctattgcgcatcgatgggccgcgttctgctggcttggctggacgaaagcgaagcacgcaccatcctggaacaaaccgaactgcgggcccgcacgcctttcacccagaaagacccggaaaaactgatggaggaactgcgccgcattcgcgcgcagggcttcgcggtcaatgatcaggagcttgaactgggcctgcgctcgattgcggttcccgttttcaatcaccgcggcgcggtcgttgcggcgctcaatattggcgcgcccgtcgcccatgtcgaagtcagcgatctggtcgggcgcatattgccggaaatgctgaaaattcaatcggaattgcgcagcatgttgcggcagcgcctgtttgaatag

SEQ ID NO: 531 - DNA, 1488 bp, Brucella melitensis
ttgacgatgagtgaactgaccgcactgaccattgccgaagcgcgcgacaagttgaaagccaaggccattaccgcgaccgagctgacggacgcctatctttccgctatcgatgccgccaatgacgccatcaatgcctatgtggccgtcacccacgatcaggcgcgttccatggccaaggcttcggatgaacgcatcgcgaagggcgaagcgggcgcattggagggcattccgctcggcgtgaaggacctgtttgcaaccaagggcgtgcacacgcaggcctgctcgcacattctggacggtttcaagccggaatatgaatcgaccgtcaccgccaatttatgggctgatggcgcggtcatgctcggcaagctcaatatggatgagttcgccatgggctcctccaacgaaacttcctattacggtccggtgaaaaatccgtggcgcgccaagggttccaatgccgatctggtgccgggcggctcgtccggcggttcggctgccgccgttgccgcgcatctttgcgcgggcgcgactgcgaccgatacgggcggctcgatccgccagcctgccgcctttaccggtacggtcggcatcaagccaacctatggccgtgtttcgcgctggggtacggtggctttcgcctcgtcgctcgatcaggcaggcccgattgcgcgcgacgtgcgcgatgctgcgatccttatgaagtccatggcttcgctcgatctcaaggacacaacttccgttgacctgccggtgccggattatgaagcagccctcggcaggtctgtgaagggcatgaagatcggcattccaagggaatatcgtgtcgatggcatgccgggcgaaatcgaggaactctggcagaagggcatccagtatctgaaggatgcaggtgccgagattgtcgatatttcgctgccgcataccaaatatgcgctgcctgcttattatatcgtggcgcctgcggaagcttcgtccaacctcgcacgttatgatggcgttcgttatggcctgcgcgtgcccggcaaggatattgccgacatgtacgaacagacccgcgccgcaggcttcggcaaggaggtgaagcgccgcatcatgatcggcacctatgtcctgtcggcgggctattacgacgcttattacctccgcgcccagaaggtgcgtacgctgatcaagaaggatttcgaggacgttttcgccaagggtgtggatgctatcctgaccccggccacgccttcggcggctttcagccttgccgatgaagtcctcgccaacgacccggtcaagatgtacctgaacgatatctttaccgtcaccgtgaacatggcgggattgccgggcatcgcggtgcctgccgggctgaacgggcagggcctgccgcttggcctccagcttatcggccgccccttcgaggaagaaacgctgtttcaggcagcccatgtcatcgagcaggctgccgggcgtttcacgccagcgaagtggtggtaa

SEQ ID NO: 532 - DNA, 2100 bp, Brucella melitensis
atggacgacagcaacgatctcttttcaagagtagtgaacaacgccagggaacggcagatggagcgccaaacgggtgaaaacaccgtggcgcaaccggtcgtgcagccggcaccatccgcgcccaagcctgtgcctgccgctgccaaggcgccgcctgctgcatcaggcggcgacgattacaacgcctcctccatccgcgttcttgaaggcctggagccggtgcgcctgcgccccggcatgtatatcggcggcacggacgaaaaagcactgcaccacctgtttgccgaagtcatcgacaattcgatggacgaagcggttgctggccacgcgaatttcatcgaagtcaccgtggataaggaaggttttgtcaccgtttccgataacgggcgcggcattcccgtggacgagcatccgcaggtgccgggcaaatccacgctcgaagtcatcatgaccaagcttcatgcgggcggaaaattcgacggcaaagcctatgaaacctccggtggcctgcatggcgttggcgtgtcggtggtcaatgcgctttcggatgtgcttgaggtggaagtggcgcgcaatcgccggctttaccgccagtgtttttcacgcggcattccgcagggaggcctcgaagaactgggcgaggttcataatcgccgcggaacgcgggtgcgctttcatcccgacccggaaatttttggcaagaatgcccatttcgacccgcaccggctttatcggatggcgcgctcgaaggcctatctgttcggtggtgtggaaattcgctggaactgcgatccctcgctgctcgaccccaagaaggaaacgccggaaaaggccgttttccactttcccggcgggttgaaggattatctggaggcctcgctcggcaaggaacatcaggttacgcgcgaggtttttgcaggccgcacggagaagcagggcgggcatggcgcggttgaatgggccgttgcatggttcggcggcgatggttttgtccattcctattgcaataccatcccgaccggcgatggcggcacgcatgaagcgggcctgcgcatcgcgctcacgcgcggcctcaaggcctatgcggaactgaccaataacaagcgcgcttctatcatcaccacagacgatgtgatggtgtcggcggctggtatgctgtctgttttcatccgcgagccggaattcgtcggccagaccaaagacaagcttgcgaccgtggaagcacaacgcctcgtggaaaacgcaatccgcgatccgtttgatcactggcttgccgcttccccgcaggaggcttcgcgccttctggaatgggtgatcgaccgtgccgatgaacgcctgcgccgccgtcaggaaaaagagaccgtacgcaagagcgcgacgcgcaaactgcgcctgcccggcaaacttgccgattgcacgcagaatgcggcagcaggtgcggaattgttcatcgtggagggcgattcggctggcggttccgccaagcaggcgcgcaaccgcgccaatcaggccattctgccgctacggggcaagattctgaatgtcgccagtgccggacgcgaaaaactgactgccaaccagcagattgccgatctcgttcaggcgcttggttgcggcacgcggaagaattaccgcgaggatgacctgcgttatgaccgcgtgatcgtgatgaccgacgcggacgtggacggtgcgcatatcgcctcgcttctcattacgttcttctatcaggaaatgccggagctcatccgcaatggccatctctatctggccgtaccgccgctctatcgcctgagccagggcggcaagaccgcctatgctcgcgacgacgcgcataaggaagaactgctgcgcaccgtgttcaccggacgcggcaagatcgaaatcggacgtttcaaggggcttggcgagatgcgcgccgaccagctcaaggaaacgacgatggacccggccaaacgtacgctgttgcgcgttcaggtggatgaggaatatggcgatgagacgcgcaatacggtggatgacctgatggggacaaagccggaagcccgcttccgctttattcaggaccgcgcggccttcgtggaggagctggatatctga

SEQ ID NO: 533 - DNA, 1845 bp, Brucella melitensis
ttgaacagatttattgcttttttccgcagtgtgtttctcattggccttgttgcgacagcctttggcgcgttgcccgcgcgggcggcaaacgagacagcacccgactatgcgctctccatgcatggcgacgtggctttgcctgccgattatacccattttccctacaccaatcccgatgccccgaaaaagggttcgctgaccgtaggcgtggtgggcactttcgacagccttaatccctttgtgctgaaaagtatgcgcaccaccgcgcgcggcctgtataatgatggcgagtttggcaatatggtgtaccagacgctgatgctgcgctcgcgcgatgagccttttacgctctatagtctgctggctgagaaagttgccatcgatcccgagcgcaaatgggtggaattcacgctcaatccaaaagccaaatggtcagatggccagcctgtcacggtggacgatgttctcttcacctatgacatactgaccgaaaagggccgcccgccctataacagccgcatgagccgggtggcgaagatcgaaaagaccggcgaacgctcagtgcgcttcacattcaacgagaaatccgaccgtgagtttccgatgctgatcgcaggctcgatgccggttctgccgaaacatgccatcaaccgcgatacgttcggcaattccacactggaaccgccgatcggcagcggcccctatgtggtcgccagtgtgcagcccggccagcggatcgtctacaagcgcaacccggactattggggcaaggatctgccctcgcagcgcggcttcaacaatttcgacaagatctccatcgaatattaccgcaacgaaacctcgctgtttgaatccttcaaaaagggcattctcgacattttcattgaaggcaatccgatacgctgggaaaagctctatgattttccggcggtcgagcagggcaaggtcatcaaggacactttcgagaagggcacaccggccgatatgctgggcttcgtgttcaacacgcgccgcccgatcttcgctgaccggcgtgtgcgccaggcccttggattgctgttcgattttgagtgggcgaacagcaatctctttgcagggcaatatcgccgtacgcagagcttctgggaggggtcgcaactttcatccgtcggcaggcccgccgatgcgcgcgaaagggagttgctggcccccttccccggtgctgtgcgcgaagacgtgatgaatggcacctggcacccgcccgttacagatggcagcggccatgaccgcgttccggccaagaaggcctatgatcttctaagccaggccggtttccagttcaaggacggcatggccatagatccgaccggtaaaccgtttgccttcgagattatgacgcgatcaccggacgaggagaaaatcgcgctcgcctatcagcgcaacctctcgcgccttggcatagcagttgaaatccacacggtggacgatgcgcaatatcaacagcgcctgcaaaccttcgattatgatatgatcctcggtgcacttgccagttcgctttctcccggcaatgagcaatggttgcggtggggttccgcctcgcgtgatgtgcagggcagcttcaactttgcgggcgtggccgaccctgccgttgatgcgatgatcgaggcgctgcttgccgcgcgcaaccgcgccgatttcgtcagcgccgtgcgtgcactcgaccgtgtgctgatttcaggtgattattatgttccgctctaccacctgccctatcaatgggttgcgcggtgggaccggattgaacatccccaaaaaacaccactttccggctaccaactgccggcatggtggcacacgtcccaataa

SEQ ID NO: 534 - DNA, 1092 bp, Brucella melitensis
gtgcaaacaaggagcacagggatcatgaaaaagacccttatggtaattgctactgtcgcgggctttatgctcggcggggcggcacatgcagaagaaaaactgaaggtgggcttcatctatatcggccctcccggcgatttcggctggacgtaccagcatgatcaggcgcgcaaggagctggtcgaggcgctcggcgacaaggttgaaaccacctttcttgaaaacgtagccgaaggtgcggatgccgagcgctccatcgaacgtcttgcccgcgcaggcaacaagctgatcttcacaacctccttcggttacatggacccgaccgtgaaggtcaccaagaagttcccggacgtgaagtttgaacatgcaaccggctacaagaccgcagacaacatgtccgcctataatgcgcgcttctatgaaggccgttatgtgcagggcgtgattgccgcaaagatgtcgaagaagggcattgccggctatatcggctccgtgccggtgccggaagtcgtgcagggcatcaactccttcatgctgggcgcacagtccgtcaatcctgatttcagggtcaaggtaatctgggtcaattcctggttcgatccgggcaaggaagccgatgccgccaaggcgctgattgatcagggcgtggatatcatcacccagcacacggattccaccgccgccattcaggtggcgcacgaccgcggcatcaaggcgttcggccaggcttcggacatgatcaagtttgcgcctgacacgcagcttaccgctgttgttgacgaatggggtccgtactatatcgaccgcgccaaggctgttcttgacggtacgtggaaaagccagaacatctggtggggtatgaaggaaggcctcgtgaagatggcgcctttcaccaatatgccagatgatgtgaagaagctggcggaagaaaccgaagccaggatcaagtctggtgaactcaatcccttcaccggcccgatcaagaagcaagacggttcggaatggctgaaagcaggcgaaaaggctgatgaccagaccctgcttggcatgaatttctacgttgctggcgtggatgataagctgccgcaataa

SEQ ID NO: 535 - DNA, 2025 bp, Brucella melitensis
atggcggttgccaccagaattggcgacctgactgaggatagcggcacaaatacggctgcagtcagcggcaataccattcgcgcccagacgatcgtgaatgatagttctaatacccttgaaggaaaactgtcggacgactatgcgtcatcaacgttgggtacctcttccttaacctttgggactcctttcggattggaacctcggcatgtaactcagggggcaatcctggcagaaacggcgcagataaacattgcaaccggccataaggcgacggtttccgagggcataataggaacccagaatacggcaaaacaagaggtggccgctggggcaagcctcagtctgcaagaaaatactattgatgcttcgcttgccgtcaacaatgcggcgaacaggattgccatcgacaaggaaggcgatccgactttccaaggctcggtccttattaccaatctgcagcagaacaaagagggctctgttgacgcagaaacgacagagtcgggtatattggcgcaagcgacagaaggagatgttgcgaatgtaatgtctattctgtcgggcagtctgaacgtagcggaaaacattgtttccagttctgcaaccggtaaccagaccgttggtgccgcaggcgccgcaggtcatcagattgtgatcggtggtcaactcagcgtcgatagcaatactaccggaaacggcagttcaacgatatcgcatgacggaggctctgcatttgccgaaaccgccgctgactttgttattgccaataaccaggcaaacatcgttacagatgcggctgatcatttgacaatctccagcgcgtctattggtgtggagggtacaccgacgattggtgcggttgttgatgccgtcgaaggaggttcggttgtcctcgcggataatgccgtgacgtctcaggcggtaggtaacaacacatccgccgcaatcttgaaggatgatgactccgcagtcggctttgatgcaacagctgcccttgctaaccatcagattaatctgttttctgatattgcggcgaccacgcaaaatggctcagtggttgccattgtcggtaaagcgagagacagtatcttcgatgaagggaccgttgatgtttcggggaacaagatttccgcactggcgtttggcaacagcgccagccagcagttggccctggacgccaataacctaaccgctggggatagcactgggttgctgacgggcgggccgaacgacgagactacccatgatagcggccttcgggctaaggcaggtgctatgcttaccagcctacaggcaaactatagcagtgatatttccgccaacaatgcggcgtcggtggttggtgtctacggcgacaacaaggttggtagcgacatatctggagccaaattaaccgtcgagaacaacacgcagcaggcgactgcgattggtagcgacgctactaatctgcttggacaagtgcattatgaggacggcaaggcggatcatgtagccggacttggcggaaacagtgtcgccggttcggccggtattgccaacgttcaggtgggtgatgctggatcgtcggtcattgcttcgttgaccgatgcggtcgcaggattcccaggaatcagcagtagggctcccataacgctaccgttttttaatgccaacgttaaacaggaggaatccagcttttcggtaaccgacaatgtgcagagcgcctcagccagcggcacccagagccgcaatgaactggtggtcgagagcaattccgtcactgccaatattggaactggtgctcaagagcatcccacttcatcaaataccggtcttgacggagcgtatgtacgcgataacgaagatagtttccataccattcatcagcctatgatcatggcggcctatggccttatcaacgatcagtcgattggggggagagtcaatgccctagaacctgtctgcattcaaggattcccttttgtacgaaattctgattcaaggttgttaaaggagaacagccgtgagcagacgaagccttacagatga

SEQ ID NO: 536 - DNA, 1578 bp, Brucella melitensis
atggttcgcgaaattttgatgacaggcatttgccttctggcgttgaacagtgccgcatcggcacaaacagtgctcaaccggggtaacgataccgatcccgcgacactggatcagcaccatacttcgaccgtttccgaaaaccgcgttctccgcgacctttatgaaggtcttctggcgcaaaatgccaagggcgaagccattccgggcgctgcctcctcttgggatatttcggaagacggcaaggtctatacctttcatatgcgcgacggcgcaaaatggtcaaacggtgatccggtgacggctggcgacttcgagttctcgttccgccgcatcatggacccgaagacggcagccggttatgcaagcgttctttatgccatccagaatggcgaagaagttgcaaccggaaaaatgccggtggaccagcttggcgtgaaggcgctggacgacaagacactccagatcacgttgaaaagccctgccccttattttcttgagcttctgacgcaccagaccggctttccggtcaacaagaaagctgtcgagaagtttggtgacaagttcacccttcccggcaatctcgtgatcaatggcccttaccagcttgtcagcttcgtaccgaatgacaagatcgtcatgaaaaagaacccgaactactgggatgccgagaacgtcaagatcgacacggtcaactggatgccctttgaagaccggtcgagctgtatgcgccgctttgaggcaaaggaagtggatatctgctccgatgtttctgccgagcagatggactatgtgaagaagaacctttccaaggaattccgcctcgcgccctatcttggcatttattacgtggacattaagggcgagccttccagcaaactgcgcgatccgcgtgtgcgccgcgccatttctctggccgcggaccgggaattcatggcggatgaggtctggcgtggcgtcatgctgcccgcctattccatggtgccgcccggcatcgccaattacgtgaaggatgcaccgaagctcgactttgccaatgaagacattctcgaccgcgaagacaaggcgaaggagcttttgaaggaagcaggcgtggagcccaatacgctgtcggtgacgctgcgctacaacacatcggaaaatcacaagaatacgatggcagcctttgccaacatgctgaaaaacatcggcatcaatgccaagctggatgaggtcgaaggcacgacctatttcaactatcttcaggaaaaaggcatgttcgacctgacccgtgacggctggatcggagattataacgatccgaattcgttcctggaactttatacaaccggcaattatttcaattatgccgaatggtcgaacaaggattacgatgcgctgatggataaatctgctgtcacgaccgatctcgccgaacgtgcgaagatcctggctgaggcagaagagattctcctgaaggaaggggctatcgtgccattgatgtattattcgtcgaccgcattggttgccgacagggttcaaggttacgacgataacctcatgaactcgcacggcacgcgctggctatccgtcaagaactaa

SEQ ID NO: 537 - DNA, 978 bp, Brucella melitensis
ttgtgggcttggcagttgccgccgttcaaacacagtgtcgaaacgaccgacaatgcctatgtgcgcgggcaggtgacggttatgagcccgcaggtttcaggctatataaccaaagtcaacgtgaccgattacgagcaggtcaaaaaaggcgatctgctttttgagatcgatagccgcagctatcagcaaaagctggatcaggcgcttgccgcgttggacagcaagaaggcggcacttgccaattcggagcagagccagcgttccgccgaggcaacgataaaggcgcgagaagcccagatatcgggggcaaaggcggcgcttgaagtggcaaaagccaatacggttcgtgtcgatgccctgttgccgcgcggtgtgacgacacaaagctctgccgatacggcacatggcaatatgcttcaggcgcaggctgcggtcgatcaggccgaagcggcactggccgttgcgaaggaggatttgcgcaccatcatcgtcgcgcgtgaagggctcaatgccgacctgcacaatgcagaggctgcggtggcgctggccaggatcgacctccagaacacgaagatccttgctccaagggatggcaagcttggcgaagtcggtgtgcggcttggccaatatgtcaccgcaggcacacagcttgtttcgctcgtgccggccgtcaaatggatcatggccaatttcaaggaaacgcaactttatggcatgaaggtcggccagccggttacgctgacggtcgatgcgctccgccatgcggaactgaaggggcatatcgaggctttttcaccggcaaccggctctgaattcagcgtcatcaaatccgacaatgcgaccggcaatttcaccaagatcacgcagcgcttgtctgtccgcatttccatcgacgaagggcagccggatgctgaattgctggcgcccggcatgtcggtggtggtgcgtgtcgatactgcctccacgccggataaataa

SEQ ID NO: 538 - DNA, 1179 bp, Brucella melitensis
ttgctggcgacaggtggtctggcggctgcggatggaaatatttatcgcgtcggtgcgaatgatgttttgcaggtgacggtctatgggcagcccgcactgaccgggctttatccggtcgatgtggatgggaatatcggttatccggtggttggaaacatctccgtgcaggggctgaccacgctgcaaatcagtgagaagattgcctcctccctttcccagcatattccgggtctgactgtcaccgcgacgatcaatcaatatgcgccggtgtttgtgatgggggacgtcaaagcccccggcaagtacgaatttcgccccggcatggtggcgcttgaattgatggctctgggtggtggcgcgggaaagggcgaagcaccttccgttaccgctggaatgcagcttatttccgcgcagcaggaatatgccgatttgcaaatgcagataacggcgcagaccatccgccgcgcgcggtttgaggctgagttgaagggcacggatttcacctatgccgtgccggagcaaacggcagccaacaaggacatggtcgcgctgacccggcatatggtggaaggcgagcgaaccctgttcgatatgcgtcgcaacaatcttgccgccgagcgtcgggcgctggaagcacaggctgcaagctacggcgatgaaatcacgaccttgcaacaaagcatcaagctgcatgacacggaaatccagcttttgcaggaaaacgtaaattccagcaaatcgctggtggatcgtgggcttgctgccaaatcaagcctgcgggacatggagcgcgacctgtcatccacccggcgcgatgcgctggaactggcctcgtttctggcccgtgcacggcagaaccagcttgcagttgagcagcgtattgccaatctggatgaaacccgccgaagcgaggcggccagcagtttgcaggaaattgatctcaacatggcgcggatgcagcggcgcagcaattcccagcttgaggccatggcggagatcgccaaatcctccggccagatttcctctgccgatatgcgccgcaagctgattttcaccatcagccgcaatgtaaatggggcctatcaggaaattgcggccaatgaacgaacagaaatcaagcccggcgatattctgcgtatcgagcttgatatgagcaaacttggcggctcgccatcatag

SEQ ID NO: 539 - DNA, 2190 bp, Brucella melitensis
gtgattatctccgacgtttcatcagcaaacgggcggcagccggttgccgacctgcttgagaccatcaaacgcagaaaactcatgctgacactgccgatcatcgcgggtgtgggcgtcggctttgccggttatctgacagcgccggtgagttatgtttcggaatccgtgctggtgctggacatgcggcgcttgcaggccttgccgaacgaaagtgccatcacgccgctgccgcaggacagtcccgtcctgcgctcggaactggacatcatcaattcacgcatgatggcgcaaaaggtcatcgaacttttgcaggcggagaatatcgccgtgccgacggacgtgcattcacgcacggttctgtcatcgcaacctgacaggatcaccctgtcgaagaatgcgcgcgatttcgatccggcagtacgtgagcgccagcagattgacctgcttttgtcccgcctgcgggtgagtaatgacgggcgctccttcacgatcttcatttcctatcgcgcgccggacccggtttacgcggccagggtcgccaatgcttttgcgacggcctatctgaaccatcaggtggatgtgcagcaatcagcagcacggcgtgtcagcgagtggctgggtgagaagctcgtcaccttgcgcaatgatctggaaacggcggaacgggttgcggaagatttccggcagaagtcacgccttgcgggcgagcaggggcagatatcgtttcaggcgcaacgtgtgatggcgctgaatacggagattgtcgccgcaaccggcgcagtatccaccgcgcaggcaaggctgcaaaccgcacaggcgttgaaaaacaacaatgaagcgccagccatgacggagatactggcttcgcccgcaatccagaacctgcgcaatgaagaagcgcgggtgcaacgccatctcgatgagttgaaggcgaacggcgctttgaaaagcgcggaaattccggttcttatggcagaacgggagtcgttgaagcagcagatcactgcacaggtggacgagattatcaaaagcctcagcaatgaaatcaggattgccgtgcaaaggcggaccagcctggagaaagaactgaaagaggcggaaacggatctcgccaaggccaatcaggcacaggtgcgcgcagcgcagcttgatcgtgaggccaatgccagccgcgtcgtctatgaaacttatctgacgcgctacaagcagttgatcgagcaggacggcattgccataccggaggcgcaactgatttcgcaagctgaaccggccatggcaaaggcaagccccaggctgattaactggcttctggtcgggcttgggcttggcggcttgtttgccgttgcaggcacgatgcttcgggaggctttggacaagatcaggccagcccagacgaccgcgcttgcgctgccgggcatcccggcggcaaccttgctgccggtctcaccccaactgaccgtgccaatactcgtcaatcgcggtgttgattcggcaagcccctttggccgggctatcaaatcggtgcatgatcggctgcgcgcgctcatacgtggccgcgattcactggcgctttccgtggtgtcgctttcggaaggcgacggcaagggcctgctggttacggcgctggcgcagcagattgcggcaaccggtgttccggttgctgttatcgacacgacttgcggaaaatcgggcttaggggaggcgttcggcctgccggtaggcaacatgcagtctttgatcggccgtaaactgaatggtgcggcgcttatccacgatcatggttccggcattgatttcattacgcctaacagacaggcgcaggaaggcgaatggctgggcgaattaatcgcgcaattgcggcctgaccacaggattatccttgtgaaccttccttcatatgcagaagacaagcgctccgcgcttatgacgcgcgcaactgacacggcgcttcttgtcgtcaatgcggatcgccgcgatgccaaagcaaccgcggctatggtgcaagtgcttgcatccttcgggcgcaaaccggccttggcggtggtcagccagatggcgtcgccttacgccgggtggattggaaaacacattgtggcccatggctgggcagagcggatcggcgcgcatttgcgcgcaatccgggtgagggggcgcgaagccccgtccaccccgatggaagaacaggcatag

SEQ ID NO: 540 - DNA, 1260 bp, Brucella melitensis
atgcggaaagcggcccgaaacacaaataattctttgagggagaaaagaatgagactgtccaggctccttatcggcgcatcgctcggcgttgcgctttcgtccactgtcttcaccgcggcactcgccgatgtgaaattcggctcgctttatccgatcagcggttcgcttgcgcttctgggtgaagaaagcgcacgcggtctggaacttgccgtagacgaggtcaatgcggctggcggcatcaagggtgaaaaagtcgtgcttgagcgcggcgatgccgttgacaacaaccaggctaccggtgaggctcgccgcctgatctcgcttgtgggtgtgaaggcgattttcgggacttattcttcggcgcgggttattgccgcctcgcaggtgagcgagcttgcaggcataccctatttcgaaatgggtgccgttgccgacgaggtgacggggcgtggcttgcaatatcttttccgcaccaatccgaccgcggaaaacatggccaaggactctgtagatatgctcatcaagggcattgctccgggcctcggcaaagaccccaaggatatgaaaatcggcattatttatgaggactcttcctatggcacatccgttgccgggcatcaggaagataacgcaaaggcagccggtctcactgtcgttctgaaatccggctatccatccaacacagtcgacatgtcttcgctggttctggagctgcgcgagaagggtgcggatgtcgtcatgcagacgtcctaccagaacgattccgtcctgttcctgcaacaggccaacgaagcgggctataagccccttgccatcatcggcggtggcggcggttattccatgcagccaacggcggacgccgtgggacatgacctgatcgacggcgttttcgatgccgactatacgcaatatgcagtcaacacctccgccacgccgggcctgaccgaatttgtggaagcctataaggccaaatatggctcgcaaccgcgttccggccattcgctgaccaattatgtcggggcgaaggcgatttttcaggctttgaacgctggggaaggctttgaaccggaccagatcgtaagcgcagtcaaggcactggacattccggacggccaggcggcagcaggctatggggtcaagtttggcaagaacaaccagaatgagcgtgcgacgatgatggggatgcagtggcaggatggcaagctcgttaccgtctatccggaaaatgccgctatcgccaagatgcgcttcaagaaatga

SEQ ID NO: 541 - DNA, 1392 bp, Brucella melitensis
atgagtctactcctcgaccgcctgaacttcctggcacgcaggaatgtcggcaccttctcggaagggcacggcgtcaccaccaatgaaagccgtgattgggaagacgcctatcgcaaacgctggcagcacgacaagatcgtgcgctccacccatggcgtgaactgcaccggctcctgctcgtggaagatctatgtcaagggcggcatcatcacctgggaaacccagcagaccgactatccgcgcacccgcgcggatctgccgaaccacgaaccgcgcggctgtccgcgcggggcgagctatagctggtacatctactcggccaaccgcgtgaaatatccgctgatccgctcgcgcctgctgaagctgtggcgcaaggaacgcgcggtgaagacgccggtggccgcatgggctgccatccagcaggacccggccaagcgttccgattatatgaaggtgcgcggcctcggcggctttgtgcgggcgacatgggatgaggtcaacgagatcatcgccgccgccaacgcctatacgaccaagacctatggccctgaccgcgtggttggcttctcgccgatcccggccatgtcgatggtttcctatgcggcgggctcgcgttatctgtcgctgctcggcggcgtctgcatgtccttctacgactggtattgcgatcttccgcctgcttcgcccatgacctggggcgagcagacagacgtgccggaatcggcagactggtacaatgccggtttcctcatgctgtggggctccaacgttccgcagacccgcacgcccgacgcgcatttctatactgaagcccgctacaagggcgcaaagtcggtcgtcgtctgccccgactattcggaagccgccaagttctccgatctctggctgcacccgaagcagggcaccgatgccgcccttgccatggctttcggccatgtcatgctgcgcgaatatcacctcgaccggcaggtgccctatttcgaggattattgccgcaaatattccgacttcccgatgctggtcatgctcacgaagaaggacggccactacgtgccgggcccgtttcgtgcgtgcatccgacttcgccgacaatctgggcgaaggcaacaatccggactggaaaacggtcggcttcgacaccaagtccggcgcctatgtcgctccgacagggttccatcggcttccgctggggcgatgatggcaagtggaacctggaagaaaaggacggcaagggcaaggatgtggaacttgccaagagcttcatcgacaaggacgcacatgatgccgttgccgatgtggccttcccttatttcggcaatctcgaccatgaacatttcgagggcaccgatcatgacagcatcctcgtgcgcaaggttcccgcccgcacgctga

SEQ ID NO: 542 - DNA, 1131 bp, Brucella melitensis
atggccgaccagatacaagtcaatcgtcgcacgatattggcgggggctgcccttgccggtgctttggggcctgttctatcggcgacgtcggcctgggggcaggggacaatgaggaaggccagcgcagaggaaattgctgcgctgccgagacagaaagtggagctggtcgatcctcccttcgtccatgcacacactcaggttgccgaaggcggcccgaaggtggttcagttcaccatggtgatcgaggaaaagaagatcgtcattgatgatgcgggcacggaagtccatgccatgactttcaacgggacggtgcccggaccgctcatggtcgtgcatcaggacgattatctcgaactgacgctcattaacccggaaaccaataccctgttgcacaacatcgatttccatgcggcaaccggcgcactgggtggtggcgggctgacggagatcaatccgggcgagaagaccgtcctgcgcttcaaagccaccaaacctggcgtctttgtctatcactgcgcacctcccggaatggttccgtggcacgtggtatcgggcatgaacggcgctgtcatggttctgccgcgcgaggggctgcatgacggcaagggcaacaagctgacctatgacaaggtctattatgtcggcgagcaggatttctatgtcccgcgtgatgagaacggcaattacaagacctatgaagcgccgggcgatgcctatgaggatacggtcaaggtgatgcgcaccctgacgccgacccatgtggtcttcaatggtgcggtgggtgctcttacgggtgacaaggccctgacggcgaaagtcggcgaaaaggtgctgatcatccactcgcaagccaaccgcgatacccgtccgcacctgatcggcgggcatggcgattatgtctgggcgaccggcaagttcaatacgccgccagatgtcgaccaggaaacctggttcattccgggcggtgcggcagcggcagccttctacacgttccggcagccgggcatctacgcctatgtcaatcataacctgatcgaagcctttgagctgggcgcggcagcccacttcaaggtgacgggcgaatggaatgacgacttgatgacatcgatactggcgccgtcggggatgtag

SEQ ID NO: 543 - DNA, 834 bp, Brucella melitensis
atgaacttcgggggcgctctcctgacagcagatgtcaggagatgcgacgggcaaccgcgccagcctggtgagcggcgcaaagatagacggatcaaaaccatgaaaccacgtcatcttcttttgatcggatcactgacggcaatcgccgtctccatcgtcagcaccggcatggcctttgccgatgaccgttattccgatctgccgcctgtgcgcgtgagccaggcgatttccgcaccatgggtcgcgcagttgcaggacgcacaggcccggccacgcatcgcacggcaggaaacaagaaaaaccaaaacgcactataacaaggtttcttaccagcgcccggcgacaaacccggcaaccacggcacgcaagaagcagtttgacccgatctatctgccgcagatcgtttcctactcgggcaaggaaaagcccggcaccatcgtcatcgatacggccagccgttttctctatctggtacaggccgacggcaaggcacgccgctacggtgtcggcgtcggcaagcaggggttcagctggaaaggcacacagcgcatcagccgcaaggccgaatggcccacatggacgccgcccagtgaaatgattgcccgcgagcgcaagaagggccgtttcctgcccgcacgcatggatggcgggatcaacaatccgctcggcgcccgcgcgctttatctgggttcaaccctctaccgcatccatggcaccaaccagccgtggaccattggcaaggccatgtcctcgggctgcattcgtatgcgtaacgaggatgtgaccgacctttacgaacgcacaccggtgggaacccgcgtggtggtccgctga

SEQ ID NO: 544 - DNA, 462 bp, Brucella melitensis
atgagcttgttgctggctaacgtgctttccacattgatggctcttgcctcgcttgcggctttgatcgtggtgggccgcaaggccaatgaaaccatcaggctcggcaaggtgctggcgctgcgcgtcgccgccgcgtcaaacggtctggagcgcgccgtaaaggcgatccgcaacgaacgtaccgaccttaccgacgccagcgccaagcttgacgcccgccttgccgaaacgcagcgcgtgcgccgtgaaatggacgaggcgatcgaggaattgaaccggctgcgcaaggcgctctcgcgcgatatgcgccaggcgtgcatcttggccgaaacgccgccaccccggcaggagaaaaccccgtccgccgcagaacaaccgctccccgcagacaagaacgcgctgcccgttttcgtgcgccgcgcggtcaagaaggcaaccgttgaactggcgggacaggcatga

SEQ ID NO: 545 - DNA, 1218 bp, Brucella melitensis
atgtccgccccgaaatccgttgataaagctgatattcgtccatttccgaccgccaaaaccgttgcgccgctccatcagcctgcaacgaatgaagcgcctgccaatgaaagaacgcagccccacgccgttccggacgaagccgtatccgccaagggcggcgcgaagaaaggcttcggcaagcgcgtcgacctgcccagccttgtagccgtcgctgccataggcgcgctctggtatggctataactggtggaccgtcgggcgcttcatggtttcgacagacgatgcctatgttcagggcgacattgcctccatcgcacccaaggtcaccggctatattgaaaacatccccgtagccgcaaaccagcaggtcaaggccggcgatgtgatcttccagttcgatgcgggcgactatcagatcgcgcttgacgaagccaatgccaagctggccacgcaaaaagaaacgctcatccgcatccaggcccagaccgatgccgccaaggccgcgctgttgcaggcaaatgccgatcagcaggcggccaaggccgtgctgctcaacgcgcagagcaccatggctcgcgtgcagaagctgcatgaaacccgtttcgtcgcgcaatccgaactcgacaatgcccagtccgccctggaccaggcccgcgccaggctggccggggtagatgcgcaaattgcatccgccaaggccaatatttccgttctcgaagcgcaatataatgaagcggcaagctctactaaatcgctggaacttgcccgcgataaggctgcacgcgatctttcgtttacgagcctgcgcgcgcctttcgacggtgtgatcggcaatctttccggcaagaagggcgacctcgttgcccccggccagaagatcgcggcgctcgtgccggtcgaccagctttatatcgatgcgaatttcaaggaaacccaactcgcccacatcaaggttggcgagacggcgcatatctatgtcgatgcgatcgacggcacgaagtttgacggcaaggtagcctccattgctccggcttccggtgcggtgttctcgctactgccgccggaaaacgccaccgggaatttcaccaaggtcgtgcagcgcgttccggttcgcatcaccattccgaaagaagcatttgaatccggcaagatccgtgcgggcctcagcgtcattgttgacgtggacacgcgcaccgcgccggaccagacggcaaactga

SEQ ID NO: 546 - DNA, 1182 bp, Borrelia burgdorferi
atgtcaataaaaacagtaaaagactttagtagctttgcgggcaagcgagctttagtaagatgtgattttaatgttcccctaaaagaggggagcattagcgatgatactagaattagggcagcattgtctacaatagagtatctaaaagaaagaggagctaggattgtgcttgtaagtcatttgggtagaccagatggaaagaaaaatcctaaatattctcttaagccggttgccaataggttgtcagagcttttaggccaagatgtcaagatgctttctgattgtattggaagtgaggttgtaaatagtaccttgcaaatgaaggatggggatgttgtattgcttgaaaatgtaaggttttatgcagaagaagagaaaaacgataaaaattttgcaaaaaaactttctgaaaatggagatgtttttgtaaatgatgcttttggcgcagctcatagagctcatgcttcaactgtgggagttgctgattatttgccgtctgttggtggatttttaatggaaaaagaagataaatttcttggtggaatattaaaaaatcccgaaaggccatttgtttcaattattggtggttctaaggtttcttcaaagattgcggtactagaatcacttttgtcaaagtctaatgtagttgtgattggcggtggaatggcttatacttttttgcattccgaaggatattctataggcaaatctcttttagaggacgaatatattggtatagcatcttcttttttaaagaaagcaaaagagctgggcgttaaagtaattttaccacttgatcatattgtagctgatgattttaacaaaaattcaattcctgagtatattgactcctttaatattcctgaaaacaagattggcatggatattggagctaatactttaaaagaaattgaaaatgttgtgaaaactgccaaaactataatttggaatggtcctcttggtgtatttgaatttgattcattttcaaaagggactgctaaggttgccgaaatggtagcatcttgctcaggtttaaccgttgttggtggtggagattctgttgcagctgttaataaatttaatttatctgataagattactcatgtttcaacgggcggtggtgcatcgcttgaatatcttgaagggagaattttgccgggtattaaggttttggagaattaa

SEQ ID NO: 547 - DNA, 1011 bp, Borrelia burgdorferi
atgattatcaatcataatacatcagctattaatgcttcaagaaataatggcattaacgctgctaatcttagtaaaactcaagaaaagctttctagtgggtacagaattaatcgagcttctgatgatgctgctggcatgggagtttctggtaagattaatgctcaaataagaggtttgtcacaagcttctagaaatacttcaaaggctattaattttattcagacaacagaagggaatttaaatgaagtagaaaaagtcttagtaagaatgaaggaattggcagttcaatcaggtaacggcacatattcagatgcagacagaggttctatacaaattgaaatagagcaacttacagacgaaattaatagaattgctgatcaagctcaatataaccaaatgcacatgttatcaaacaaatctgcttctcaaaatgtaagaacagctgaagagcttggaatgcagcctgcaaaaattaacacaccagcatcactttcagggtctcaagcgtcttggactttaagagttcatgttggagcaaaccaagatgaagctattgctgtaaatatttatgcagctaatgttgcaaatcttttctctggtgagggagctcaaactgctcaggctgcaccggttcaagagggtgttcaacaggaaggagctcaacagccagcacctgctacagcaccttctcaaggcggagttaattctcctgttaatgttacaactacagttgatgctaatacatcacttgctaaaattgaaaatgctattagaatgataagtgatcaaagggcaaatttaggtgctttccaaaatagacttgaatctataaagaatagtactgagtatgcaattgaaaatctaaaagcatcttatgctcaaataaaagatgctacaatgacagatgaggttgtagcagcaacaactaatagtattttaacacaatctgcaatggcaatgattgcgcaggctaatcaagttccccaatatgttttgtcattgcttagataa

SEQ ID NO: 548 - DNA, 1884 bp, Borrelia burgdorferi
gtggattcaacattttcaggaatagaaattggcaaaagaagtttatttgcacataaagatgctatgaatacagttgggcacaatttatccaatgctacaaagcctggatattcaaggcaaagagtaacaatgaaaaccgaaattcctctttatgctccacaattaaacagagccaaaaaacaaggacaattgggacaggggattgttgttcaatctatagacagagtaaaagatgaactacttaacacaagaatcattgaagaatcgcaccgactaggatactggacttcacaagacaagtttatatcaatattagaagatgtttataacgaacctgaggatcaatcaataagaaaaagattaaatgatttttgggaaagttggcacgatctagcaaatcaaccacaaggtttagcagaaagaaaaataattctagaaagaggcaaatctttttgtgaaggaataagaaatagattccattcgcttgaaagaatttacataatggcaaacgatgaaataaaaattacaacggatgaggcaaacaattacattagaaacattgcaaatcttaataaacaaatttcaaaatctcaagcaatgaaagacaatccaaatgacttaatggatgcaagagacttaatggttgaaaaattaggcaatataataagtgtatcaattgaaaacaaacaagatcccaatgaatttttaatccacgcagaaggaagacatcttgtacaaggttcaattgcaaatgaattcaaactagaagctacaaacgggcccaccagaactagatggaacattttatgggcaaataatgacaaagcttaccttaaaacgggaaagctgggatctttgcttaacataagagatgaagagattaaaaacgaaatcaatgaactaaataatatagctgccaacattatagaaattgttaatgaaatacatgaagcaggacgtggaatggataaaaaaaatggaagaagttttttttctcaagaactaaaactaactgatgatcgaggtagatatgatactaacggaaatggtcagtttgattccgttcatattttcaaaattaacagcacaaatgaaatatttccagaagaaaaattgggattttacggaactcttaaatttgaagctacaaatagtaatgaaattgtagaaataccctacaatgctccagatacagttcaagatgtaataaatagaataaataattccaacgcacaagttacagcaagaattaactcagaaggcaagcttgaaatcaaagcagttaaagaacaagaagatgagaatataacatttaaaatcaaacatatagaagattctggatcatttctaacaaaatatacaggaatattaaatgcatctggacctgagggagcttatgattataaaaatattgacacaacagacaaattggcgcctaaatcgacttattcaatctctcctctaaaaaatcctgcagcatggataaaagttgcagacataatagactcagatccttcaaaaatagcatcgggaattaaaaatccaacaaatgaaatatctattggagataaccaagcagcactaagaatctcctcttttggaaattctcagattatgattggcaaaaatttaacattaaatgattactttgcaaatacagcatcaaatatagcaataaaaggacaaatttcagaaatcacaaaagaaagccaatctcaaatattaaaagatttaacagatctaagaatgtctatttctggagtaaacaaagatgaagaacttgcaaacatgatcgaatttcaacaagcatttattgcagcaagtaaatttatcactgtttctgttgaactaatagacacagtaataaataaaatgggagtataa

SEQ ID NO: 549 - DNA, 843 bp, Borrelia burgdorferi
ttgatgaaaaaagttattatcttaatttttatgctatcaacaagtttattatacaactgtaaaaatcaagacaatgaaaaaattgtatcaattggaggatctacaactgtaagcccaatactagacgaaatgattttaagatataataaaataaacaataatactaaagtaacatacgatgcacaaggaagtagtgttggcataaacgggctatttaacaaaatatataaaatagcaatatcatcaagagatttaacaaaagaagaaattgaacaaggggcaaaagaaactgtatttgcttatgatgctttaattttcattacaagccctgaaataaaaattacaaatattacagaagaaaatctagctaaaatactaaatggagaaattcaaaattggaaacaagtgggaggtcctgatgctaaaatcaactttatcaatcgagactcttcttctggttcttattcgtctataaaagacctacttcttaataaaatattcaaaactcacgaagaagctcaatttagacaagacggaatagtggtaaaatctaatggagaggtaattgaaaaaacaagccttactccccactcaataggatatataggtcttggatacgcaaaaaattcaatagaaaagggtttgaatattctttctgttaacagcacatatcctacaaaagaaacaataaatagcaataaatacaccattaaaagaaatttaataatagttacaaataacaaatacgaggataaaagcgtaactcaatttattgatttcatgacaagctcaactggacaagatattgttgaagaacaaggctttttagggataaaaacataa

SEQ ID NO: 550 - DNA, 537 bp, Borrelia burgdorferi
atgcctaataaagacgatgacaatttagatatgggggattccaatgttagtagaaaaggcggtttattgcctgatattataataaaaattttacaaatacttgcaataggaatatttactgttgcaataatgataattgtttcttattttgtgtctaaaatggtggtaagccaaagtggagctcctagtgattttccagttttttctaatgaatacttaggaaagccacctatgcttatatggtatgaaagtatagatgagattagaggtaacaccttagatgttcctccaaaaacttttgttgtaaagcttgctttggggtatgcagaaaataatgttaatattctcaatgagcttggaagacagaaagtgcgcttaaaagacattattagagaatattttagtcaaagaactggtcaagaaataaagaatgaaagtcaaataaaagcagaaattaaggcaagaattaatagcattcttagaaatggagaaataaaagaaatagcattaacccaaattgatatttttgatatgtaa

SEQ ID NO: 551 - DNA, 1329 bp, Borrelia burgdorferi
atgatgaggtctttatattctggtgtttctgggcttcagaatcatcaaacaagaatggatgttgttggtaacaatatcgccaatgtaaatacaattggctttaaaaagggaagagtaaattttcaagatatgatatcgcaatctatttctggagcttctcgccctactgatgctcgtggtgggactaatcccaagcaagttggattaggcatgaatgttgcctcaattgacactattcacactcaaggagcttttcaaagcactcaaaaagcatctgatcttggagttagtggcaacggattttttattttaaaagaaggtaaaaatttgttttatacaagagccggtgcttttgacgtggactctgatcgacatcttgtaaatcctgcaaatggaatgcgaattcaaggttggatggcaagagatttagaaggtgaaaaggttataaatacagcttctgatattgaggatctgattattccgattggagataaagagggagcaaagtctacgaaaaatgttacttttgcttgtaatcttgataagagattgcccttaattcaagaaggtgcgaatcctgcagatattgcacgcggaacttgggttgtcaataaatcattgtatgacagttttggaaatgttagtgttcttgagcttagagttgtaaaagatttaaatacgcctaatttatggaatgcaacagtattaataaatggtgagcaaaattcaaattttacacttgggtttgacaatgaaggagcattggcgtctttaaatggtcaaccagggcaaaaaggagatattcttcaaattcctataacatttaatgttttgggtgcaaatgtaggtgaagttggtgagcagcaaactgtaaatttgaaattgggaacagttggaagttacactgattcaattactcagtttgctgattctagtagcacaaaggctattattcaagatggatatggcatgggatatatggaaaattatgaaattgatcaaaatggtgttatagttggcatttattcaaatggcataagacgagatcttggcaagattgctcttgcttcttttatgaatcccggaggacttgcaaaatcaggcgatactaattttgtagaaacaagcaattcaggtcaagttagaataggcgaaactggacttgctggacttggtgatattagatctggtgttttagaaatggccaatgttgatcttgcagagcaatttacagatatgatagtgacccaaagaggatttcaggcaaatgccaaaaccattaccacttctgatcaattattacaagaacttgtaagattgaaaaattaa

SEQ ID NO: 552 - DNA, 1134 bp, Borrelia burgdorferi
atgaatataaagaataaattaatatcgctgctaattgtagtagcaatctcttttatcgcatgcaaaacgcctccagaatcaagagagagtaaaaatgctaaaattgcacaaccagataataaaaattttcaattaagagatataaaagacattaaaaatgaactaataagagaacggggacatcttttttattccaaagagtttaatgaagctgaaagattagaagaagcaatgaaacaaagtttttccaaaaaaaaagcaatagaaggaaatgaaattgctctaaaagtacttgaaagatacaaaacaataataagagaaacgagggaaaaaaaagaaaaaacaaattaccttaaagaaaatattgaaaagtatctaaacgatgcagaagcaaatgaagcatacatatggatcccgctggaaatcgacgaagtaaataatttatattttgaagcaacaagaaaatataaaaattacgatcttgataatgcccttgacatgtatagcaaggcctttaacagagcacaacaagcagcaaaaaatgccaaagaagctaaagctttaaaagaaactgatgagagaatgtacaaacaattaaaagcacttgaagcggcttccaacttaccaatttatagcaataataagcttataaagccatctccatggaatggtagagcattcattaaagaaagaaacagtcacttaaaccttttaaatactaataaagacacttatcttcttggagaagcagaaatttcaattccaatagtactcgcatacgaagaaaaagtggaaatagcaaaaaactccaaacctcaagaacaattcaaaacgctagaacttattgaaagatctagaacattgtgggaaaaaggggttgaggctaaaaatgtaaaaaactttagacttgccaatgaattatttttagaatctgcaagataccttgaagcttatcaaagcaatgcaagcagcgagctttacgtaataaaaataggcaataccctatggggcatttccaaaaaattatacaacgatccttacttatggccaaaaatttggtttgccaacagacaaaaaatacaaaatccggatctaattcattctaactggaagataataattcctgccaaataa

SEQ ID NO: 553 - DNA, 1587 bp, Borrelia burgdorferi
atgaaattacaaaggtcattatttttaataatattttttctaacttttctttgttgtaataacaaggaaagaaaagaaggagtatcatttaaaataagcttgggagcagagccaagcagtcttgaccctcaattagcagaggataatgtcgcatcaaaaatgattgacacaatgtttagagggattgttacaggagatcctaatacagggggaaataaaccgggacttgcaaaagggtgggatatttcttctgatggaacagtttacacatttaacctaagagaaaaaatcacttggagtgacggagttgcaatcactgcagaaggaattagaaaatcttatcttagaattttaaataaagaaactggctcaaagtacgttgaaatggttaaatcggtaattaaaaatggtcaaaaatattttgatggacaagtgactgactctgaacttggaattagagcgattgatgaaaaaacattagaaataacactggaatcaccaaaaccttattttattgatatgttagtacaccaatcatttattccagtaccagttcatgttaccgaaaagtatggacaaaactggacaagccccgaaaacatggtgacaagtggtccttttaaattaaaagaaagaattcctaacgaaaaatatgtctttgaaaaaaataacaaatactacgactcaaatgaagtagaattagaagagattacattttacacaacaaatgacagctcaacagcgtataaaatgtatgaaaatgaagagctagatgcaatttttggttccatacccccagatctaatcaaaaatctaaaattaagaagcgactattactcatcagctgttaatgccatatacttttacgcgttcaatacacacatcaaaccacttgacaacgttaaaattagaaaagccttaactcttgctattgacagagaaacgcttacatataaagttcttgacaacgggactacccctacaagaagagcaactcccaactttagttcatattcttatgcaaaaagtttagaattatttaatcctgaaattgcaaaaacccttctagctgaagctggatatcctaatggcaatggatttccaattttaaaattaaaatacaatacaaacgaagcaaataaaaaaatttgtgaatttattcaaaaccaatggaaaaaaaatttaaatattgatgtggaacttgaaaacgaagaatggacaacatacttaaacactaaggcaaatggaaattatgaaatagcaagagcaggatggataggcgattatgctgatcctttgacatttttaagcatattcacacaaggatacacacaattctcatctcataattactcaaacccagaatacaacgaacttataaagaaatccgaccttgagcttgatccaataaaaagacaagacattttaagacaagcagaagagataattattgaaaaagattttccaatagcaccaatatacatatatgggaacagttaccttttcagaaatgacaaatggacagggtggaacaccaatattttagaaagatttgatttatctcagctaaaattaaaaaataaataa

SEQ ID NO: 554 - DNA, 1302 bp, Borrelia burgdorferi
atgggttttcacatttatgaaatcaaagccagacaaatcattgattctagagggaatccaacagttgaagctgatgtcattttagaagatggaacttacggaagagctgccgtaccatcaggtgcatcaacaggaattaacgaggctgttgagcttagagatggtgataagtctgtatatatgggaaaaggggttttaaaggcaattgaaaatataaaaaacataattgccccagaacttgaaggtatgagtgccttaaatcaggttgcaatcgacagaaaaatgcttgaacttgatggcacccctacaaaagaaaagcttggtgctaatgcaattttagcagtttcaatggctacagctaaagctgctgcaaagtaccttggacttaggccttatcaatatcttggagcgtacaaagccaacattttgcctacacctatgtgtaatattattaatggcggtgcacactctgacaactctgttgactttcaggagttcatgataatgccaataggagcaaaaacattcagtgaagcaataagaatggcagcagaggtttttcatacgctaaagggcattctaagtggcaaagggtatgcaacttctgttggagatgaagggggatttgctccaaatttgaaatcaaatgaagaagcttgtgaagtgattatagaggcaataaagaaggcaggatatgaacctggaaaagacattgcaatagctcttgatcccgcaacatctgagctttatgatccaaaaacaaaaaaatacgtacttaaatggtcaacaaaagaaaaacttacttccgaacaaatggttgaatattgggcaaagtgggtagaaaaatatccaatcatttcaattgaagatggaatggctgaagaagattgggatggatggaaaaaacttacagacaaaattggaaacaaaatacaacttgttggagatgatttatttgtaacaaatacctcgtttcttaaaaaaggaattgaaatgggagttgccaattcaatccttattaaggtcaatcaaattggaacactaacagaaacatttgaggctgtagaaatggctaaaaaagcgggttacacagcaatagtctctcacagatcgggagaaacagaagatacaacaatagctgatcttgtagtagctcttggaacaggacaaatcaaaactggttcactctcaagaacagatagaatagcaaaatacaatcaactcataagaatagaggaagaattggaaacaactgctgaataccacggtaagagcgtcttttattctattaaacaaaaataa

SEQ ID NO: 555 - DNA, 1434 bp, Borrelia burgdorferi
atgatttcaaagttaacaaaaattgtagcaacaatatctgatcttagatgcgaaccagaacatataaaagatttacacgatgcaggggtaaatgttataagactaaatactgctcatcaatcacacgaagatacaataaaagtaatagacaatgttagaaaaatttcaaataaaatagctttaatgattgatacaaaaggaccagaagttagaacagcaaatattgaaaatcctattattgtaaaaactggagacaaggtaatcatttcaacctcgcctattaatgagcctaataactttcaaaccaattatgatggatttgttaaagaagtaccccaaggatctaaagtgctaattgatgacggtgaacttgaaatgactgttgttgccaaattgcctgacagattaatttgtgaaattaaaaatgacggccaaattaaaaataaaaaatcaatcaatacccccggaatttctcttaagctacaatcagtaaccgaaaaagacaaaggatttattgagcttgcagcaaaatataatgttgattttattgcccattcgtttgtaagacattccaaagacgttcaagatgttcaagaaattttaactgcctctggaaatcctgatgtaaaaattatatccaaaatcgaaaatcaagagggaattgacaacattgaagaaattgcaaaagcttcttacggaataatggttgcaaggggagacatgggagttgaaattcctgcagaagatgtacccattgctcaacttaaaataacacaaacctgtataaagtatggaatacccgtgattacagcaactcaaatgcttcatacaatgattgaaaatccaagacctactagagcagaagtgtctgacatcgctaacgctattttaaacggcacagacgcaattatgttatccggagaaaccgcctacgggaaatatccaattgaagctgtaaaaatgatgacaagcattgctaaaaaagttgaaaaacacagaaaaatgaccttatataaggatgaacttttttacgataaaagtatcacaagaaactatattatcaaatgtgcaattgatgccacaaaacttatggacataaaagcaattattgtagattctctaaaaggcaaaaccgcaagaataatggcaacctacagagcaagtgttccattattcattacaacaaatagcgaaagactagcaagagaattagcattatcttacggggtttattctaatcttgtagacaataatttcaaaagaactaccgaatttgtagtaacttctcttaaaatgttaaaagaacaaggtgttgttaatgacaaagatactgtaataattatttctggaaatccaaatagaaatattgaaaaaggaacagaatttatggaaataaacacagtagaagatgcaatcaaaggacgaaatatataa

SEQ ID NO: 556 - DNA, 1427 bp, Borrelia burgdorferi
atgaaaaataaatttttaatatgtgtatattttttattgactctgggtataagctctttagtaattgttgaatctatttttgcttttgatgaatctaataataagttatcaagatcaaattatgagcagatgatgattcaagcttttgaatttgtaaaagaaaattatgttgatcctgtaagtgatgaagtaatttttgaaggtgctttaaaaggaatatttcaatccctaggcgatccttattctcaatatttgacaaaaaaagatttagaagaaatttcaaaaacaacagtaggagattatgttggcattggaatttctataataaaaaaaatgcattcccaagataagcaagacaaggcaaaagattttgatcctaatagtgcttgtgtttctattgttacgccttttgaaggaggtccggcttataaggctggaattaaatctggagattgtattaccgctgttgatggcaagagtgtttattctatggaagtagatcaagttgttgatcttttaaaaggtaaagaaggcacaaaagttaaagtatctattcttaggggaaaaaatttaacattggattttgaacttacaagagagaagatagaaatacaaacatcaagtatgacgttattaattcagatattggctatataagaatagtaagctttaatccacacacctctgtagattttagaaaagctttagataatcttaagaataaaaatattaaatctttaattttagatttaaggcttaataccggaggatattttcaggcagctataaaaatggcggatgatattttatctaaaggaattattgtttccacaaaatcaagaaattctagcaagcctattgattataaggcaagctcaaaacaagttttgccttcaaatataaaaattgttgctttaatagacagatcatcagcctcagcatcagaggtttttgtaggagccttaaaagacaataagagagcatacattataggggaaaagtcttatggcaaggggcttattcagcatgtagttcctttttatactggtggatttaaaattacaagctcaaagtattatactccatctggaaagagtattcataaggttggaattgagcctgatttggaaataaaatctccagatttttctgaggaggaggcattaatatataaagaaatttttgataaaaagctgatagaaggttttttgaagggtaaaaaattcattaccgaacaagagattgatttttttgttgagaatcttgtaaaagaaaatccaaaatataaaattgataaagaatttttaggcaagtatgtgttttttaattactatcaggacaataataaagaattgccaatttataatctacattatgacaaagttttaaaaacagcttgtgagtatttgtctaaattaggtaattaa

SEQ ID NO: 557 - DNA, 585 bp, Borrelia burgdorferi
atgtataaaaatggtttttttaaaaactatttgtcattgtttttaatttttttagtaattgcttgtacttcaaaagatagctcaaatgaatatgttgaggagcaagaagcggagaactcttctaagcctgatgattctaaaatagatgaacatactattgggcacgtttttcacgctatgggagtagttcattcaaaaaaggatcgaaaaagtttggggaaaaatataaaggttttttatttttctgaagaagatggacattttcaaacaataccctcaaaagagaatgcaaagttaatagtttatttttatgacaatgtttatgcaggagaggctccaattagtatctctggaaaagaagcctttatttttgttgggattacccctgactttaaaaagattataaatagcaatttacatggcgctaaaagtgatcttattggtacttttaaagatcttaatattaaaaattcaaaattggaaattacagttgatgagaataattcagatgccaagaccttccttgaatctgttaattacattatcgacggcgttgaaaaaatttcacctatgttaacgaattaa

SEQ ID NO: 558 - DNA, 1878 bp, Borrelia burgdorferi
atgttttttaattttttgaaaaaagatcttgtatttgttttgccagaagtaaattcaaaagaagatgtaattgattttttaattgaaaaaatcaatgataagggatatatagataataaaaaagagtttcttcaaggaattcttgatagagaaaagataggtgacacttcttgggaaaatggggttgcaattcctcattttataggagatgttgttaagactagttttatttcattgctttacattaaaggttctggggttaagtggtctgaagaaaacccccctgttaatttaatatttttgatttgtatgtcaaaaaaacaacaaggtaatgaacaccttaaggcgattgcttttatagctaaactatttgaagatgatgcttttcaaaatgctttacgcgggtttgttactactgatgacatttattattatattgaaaatgttcaaagaaaggctaaagaagaggtttttggagctacaaaagcagaaaaaatagtggccgtaactgcttgtcctgttggagttgctcatacgtatattgcagctaagaaaattgaaaatgaagctaaaaagcagggttatagcattagagtagaaactcaaggatctattggtattgaaaatgccttaacagaagaggaaattaagaatgcgtccgttgtaatacttgctgttgataaggatattgatgaaaagagatttgaaggtaagagagtttataaagtttcaactgtaaaagcgataaacaatacagaaaatattattaaggaatcttttaatgctccggtatttaaaagcaaagactccggtactaatagtgatactaaagcttcggttgcaacaggcaaaggtagtttttataaatatttaatgagtggggtatctccaatgattcctgttgttgcaagtggaggaattttaattgctcttagcattgcttttgttgggattggacctgatgggcctaattttgctgagcatccattttataagcagattgcagatattggttctatagcttttgggatgatgttgcccgtgcttgctggttttattgcaatggcaattgctgataagcctggtcttacccccggtcttgttggtggagtaatgtctgggaatgtaaaagcaggtttcttgggcgcaatatttgcgggctttcttgcaggttatgttgcaaggtttttagcaagaagatctgttcctgagtggttaagacctgtaatgcctatatttgtaattccgctaataagcaccattattgtcggcttttttatgctgtattttggtgtttatattggaaaatttatgggggtgcttgagagtgggcttaaatctttacagagtaattcggaaacttttggcgtgttgggtaaaattttcttaggcttagtactaggttcaatgattactgttgatatgggcggaccttttaataaagtggcatttctttttggtgtagggctaattcctcaagtgccagaaataatgggaatggtagcagcagcaattcctgttcctcctatggctatggggcttgcaacctttttagcacctaaattgtttgaaaatgaagaaaaagaatctggtaaaatagcctttttaatttcatttattggtattagcgaaggagctattccttttgctgctagtgatcccggacgggtaatcccttcgatagtggtagggggagctgtatcaagcattattgccgcttttttaggcgttgctaatcatgctccacacggaggaccaatagtacttcctgttattgataataaatttgggtttattattgcaattgctgttggagttgcggttgcaacagctttggtaatttttttgaaatctttaaaattaaaggaatctgaatga

SEQ ID NO: 559 - DNA, 1206 bp, Borrelia burgdorferi
atgaaatttaggaggttagtcatggcaaaagaagtttttcaaagaacaaagccgcacatgaatgttggaacaataggtcatgttgatcatggtaaaacaacactaacagcggctattagtatttattgttcaaaattaaataaagatgcaaaagcattaaagtatgaagatattgataatgcacctgaagagaaagcaagaggaataacaattaatgctaggcatattgagtacgaaacagctaatagacattatgctcatgtagattgtccaggccatgccgattatataaaaaatatgattacaggagcagctcaaatggatgcagcgatacttttagttgctgctgatagtggtgctgagcctcaaacaaaagagcatttgcttcttgctcaaagaatgggaataaagaaaataatagtttttttaaataaattggacttagcagatcctgaacttgttgagcttgttgaagttgaagttttagaacttgttgaaaaatatggcttttcagctgatactccaataatcaaaggttcagcttttggggctatgtcaaatccagaagatcctgaatctacaaaatgcgttaaagaacttcttgaatctatggataattattttgatcttccagaaagagatattgacaagccatttttgcttgctgttgaagatgtattttctatttcaggaagaggcactgttgctactgggcgtattgaaagaggtattattaaagttggtcaagaagttgaaatagttggaattaaagaaaccagaaaaactactgttactggtgttgaaatgttccagaaaattcttgagcaaggtcaagcaggggataatgttggtcttcttttgagaggcgttgataaaaaagacattgagagggggcaagttttgtcagctccaggtacaattactccacacaagaaatttaaagcttcaatttattgtttgactaaagaagaaggcggtaggcacaagccatttttcccagggtatagaccacagttcttttttagaacaaccgatgttactggagttgttgctttagagggcaaagaaatggttatgcctggtgataatgttgatattattgttgagctgatctcttcaatagctatggataagaatgtagaatttgctgttcgagaaggtggaagaaccgttgcttcaggaagaattcttgagatattggaatag

SEQ ID NO: 560 - DNA, 1908 bp, Borrelia burgdorferi
atgggcaaaataataggtattgacctaggaacaacaaactcatgcgtagctataatggagcatggaaaaccagttgtaatacaaaattcagaagggggaagaactactccatctattgttgcttacacaaataaaggcgaaagacttgtggggcaagttgcaaaaaaccaaatggttacaaaccctgaaaacacaatttattctattaaaagatttatgggaagaagatttgaagaggttgcaagcgaaataaaaatggttccttataaaatagaaaaaggactaaatggcgatgcgcgagtaaacatttcaaatataaaaaagcaaatgtcaccgcctgagatctcagcagcaactcttacaaaaatgaaagaaacagcagaggcttatttaggtgaaaaagttacagaggctgttatcacagttcctgcttactttaatgatgctcaaagacaagccacaaaagatgctggaaaaatagcaggtcttgaggtaaaaagaattgttaacgagccaactgctgctgctcttgcttatggaattgaaaaaaaacacgaagagatcgttgctgtttacgatcttggtgggggaacatttgacatttcaatattggaacttggagatggtgtttttgaagtaaagtcaaccaacggagacacacatcttggtggtgacaattttgacgacgaaataataaaacatttaatttcagaattcaaaaaagaaagcgctattgatttatcaaacgacaaaatggctcttcaaagactcaaagaagcagctgaaaaagctaaaatagaactctcaggcgctcaagaagcttcaataaatcttccatttattacagcagatgcaaatggtccaaaacacttacaatatactctaacaagagcaaaattcgaacaaatggtagaccacttagttcaaaaaacaaaagaaccatgccttaaggctattaaagatgctgggcttaaagcttctgatattaatgaagtaatacttgtaggtggatcaacaagaattcctgctattcaaaaaattgtaaaagatatatttggacaagatcctaacaaaggagtaaatccagatgaagctgtagcaattggagctgctattcagggtggcattctaacaggagaaactaaagacatggtactccttgacgttactccactctcactaggaatagaaacactaggcggggttatgactaaacttattgaacgaaacaccacaattcctacaaaaaaaagtcaagtattctcaacagctgctgacaatcaaacctctgttgatattaaagtccttcaaggtgaacgtgaaatggcagcacaaaacagaatacttggtaattttatacttgatggaataccagcagcaccaagaggagtgcctcaaattgaagttagctttgacattgatgctaatggaatagttcatgtgtctgcaaaagatatgggaacgggcaaagaacaaaaaattagaattgaatcatcatcaggactctctgaatcagaaatagatcgaatggtaaaagatgcagaagctcatgcggaagaagataaaaaattaaaagaaaatattgaagcaaaaaatacagctaattctttaatttatcaaacagaaaaatcattaaaagaatattctgaaaaaatttcaagcgaagacaaagaagctattgaaagtaaaataaaagaattaaaagaaagtcttgaaaaagaagacatttcacttataaaatctagaacagaagaacttcaaaaagcttcttacaaaatagctgagatgatgtataaagattcttcccagcaaaatgcaaacagccaacaagaaaatggcccacaaagcaatacaagcgaagagggtaaagaggctgattatgaggttgttgacgaggataaaaaatag

SEQ ID NO: 561 - DNA, 657 bp, Borrelia burgdorferi
ttgtatatgattaggcttaaagttttaattttgtgtttatttgggatttttgtgttaaatggttttgcagatactaattttgaattcaattttggtggtggggttgcttttcctgttagtcccttttcaagcttttacaatgaggctttagagattaatgcaaagcttaagcaaaatttgccttcagatttatccccaatagaaaaagaagagatagtccaaaatttttccgatttagccaatattgctaaagctggaataagatatggaacttacgctcaatttggcgctaaatttgatgattttgtttctattggatttgagcttttgtttaacattaatcttcttaaagcaataaagcgttcggatggaactgcaaatgaaaatttctcgtttattatggcaataacaccaagattttatacaaaattagatttttttgttttagctttagcgtttttcacaggtcctaagatcaatatagcgacttcttctgcggattctgttttagcagaactgggaacaatgggctgggatattggtgctagactttcattttcttttttaattcttgaagggtactatgtttggaatattaaaaaccctaaattttctgatttcaagtttggaataggttttgaatttggaattgtgtag

SEQ ID NO: 562 - DNA, 1857 bp, Borrelia burgdorferi
atgaaaagccatattttatataaattaatcatatttttaaccacatctgcagcaatatttgcagcagacgcattaaaggaaaaagatatatttaaaataaacccatggatgccaacatttggatttgaaaacacaagtgaattcagattagatatggacgagcttgttcctgggtttgaaaacaaaagcaaaattaccattaagcttaaaccatttgaagctaatcccgaattaggcaaagacgatccattctcagcttacattaaggtagaagatcttgcactaaaagcggaaggcaaaaaaggcgatcaatttaaaattgacgtgggagatattacagcccaaatcaatatgtacgatttttttattaaaataagtactatgacagattttgactttaataaagagtctttatttagttttgcacctatgactggatttaaaagcacttactatggattcccaagcaatgatagggcagtaagagggacaattcttgcaagaggtacttctaaaaacataggaacaattcagctgggatacaaactcccaaaactcgaccttacatttgcaatagggggaacaggcacgggtaacagaaatcaagagaatgacaaagacactccatacaataaaacatatcaaggaatcctttatggaattcaagcaacatggaaaccaataaaaaatctacttgatcaaaacgaagatactaaatctgtaattgcagaaacaccttttgaattaaattttggcttgtcaggagcctatggaaacgagacattcaataattcatcaataacatactctttaaaagataaatccgtagttggcaacgatttattgagcccaactttatcaaattctgcaattttagcatcttttggagctaaatataagcttggattaacaaaaataaacgataaaaatacctatcttattttgcaaatgggaactgattttggaatagatccttttgcaagcgatttttctatatttggacacatctcaaaagcagcgaatttcaaaaaagaaacaccctcagatcctaacaaaaaagctgaaatatttgatccaaatggcaatgctcttaatttcagcaaaaacacagaattgggcattgcattttcaacaggagcaagtataggttttgcttggaataaagataccggtgaaaaagaatcctgggcgattaaaggatctgattcctacagtacaagactctttggagaacaagacaaaaaatctggagttgcattgggaataagctatggacaaaacctttacagatctaaagatacagaaaaaagattaaaaaccatatctgaaaatgcatttcaaagcttaaatgttgaaatttcaagctatgaagacaacaaaaaagggattataaatggattaggatggataacatctatcggtctttacgatattttaagacaaaaatctgtagaaaactatcctacaacaatttcaagcaccactgaaaacaatcaaactgaacaaagttcaacaagcacaaagaccacaacccctaatctgacatttgaagatgcaatgaaactcggcttggccttatatcttgattatgcaattccaatagcatccatttcaacagaagcatatgtagtaccttacattggagcatacattttaggaccttctaataaactctcaagcgatgctacaaaaatttatttaaaaacaggacttagccttgaaaaactaataagatttacaacaatttctcttggatgggattcaaataacattatagaacttgctaataaaaacacaaataatgctgctattggaagtgctttcttgcaattcaaaatagcctacagcggaagctaa

SEQ ID NO: 563 - DNA, 1638 bp, Borrelia burgdorferi
atggctaaagacatatattttaatgaggatgctagaaaaagcttacttagtggcgttgaaaaattatccaatgctgtaaaagtaactcttgggccaaaagggagaaatgtccttattgataaaaagttcggctctccaacggttacaaaggatggggttagcgttgctcgtgagattgagcttgaaaatccgtttgaaaacatgggggcacagcttttaaaggaagttgctattaaaacaaatgatgttgctggtgatggaacaacaactgctactgttcttgcttatgctattgcaagagaaggccttaagaatgtgtcttcaggaatcaatcctattggaataaaaaagggaatagatcacgctgtaaatttggctgctgagaaaattcgtcagtctgcaaaaaagattacaacaaaagaagagattgcacaagtagcttcaatttctgctaataatgacagttatataggtgaaaaaattgctgaggcaatggataaagttggaaaagatggtgttataacagttgaagagtcaaaaacctttgatactacgatttcttatgttgagggtatgcaatttgatagaggatatctttctccttatttttctaccaataaagaaaatatgagtgttaattttgacgatgctttcatattgatatatgagaaaaagattagttctattaaagagcttttaccagttcttgagaaagttttagggacaaataaacctttattaattattgctgaggatattgagggggatgctcttgctgctcttgttttaaacagcgttagaggagctttaaaggtatgtgcaattaaatctcctggttttggtgatagacgaaaagcaatgcttgaggatattgcagtgcttaccggcggtgttttaatcagtgaggagctaggccttactcttgagacagttgaaattgagcaacttggacaggctaaaactattaaggttgataaagacaataccactattattaataccggcaataaagagcaaataaaggagcgttcagagcttattaaaaagcaaattgaagattcaacatctgaatatgataaagaaaaacttcaagagcgtcttgcaaaacttgttggcggagttgctgttattaatgttggagctgttactgaggtagagcttaaggagaaaaagcatagagttgaggacgctctttctgcaactcgtgctgctgttgaagagggtgttgtgcctggcggtggatcaactcttattgaagttgctatgtatttagatacaatagatacaagtaaattaagctatgaggaaaagcaaggttttgagattgtaaaaagaagtcttgaagagccaatgagacagattatttcaaatgctggttttgaaggatctatttatattcatcaaattaaaacagaaaaaaaagggcttgggtttgatgcttccagctttaagtgggtaaatatgattgagagtggaataattgatcctgctaaggttacaagaagcgcgcttcaaaatgctgcttcaattgctggacttttattaacaacagaatgtgcaatcacagatattaaagaagagaaaaatacttctggtggtggtggttatcctatggacccaggaatgggaatgatgtaa

SEQ ID NO: 564 - DNA, 1035 bp, Borrelia burgdorferi
ttggtttacatgaaaaggaaagctaaaagtattttattttttttattatccactgttctttttgctcaagagactgatggattagcagagggttctaaaagggcagagcctggagaattagttttagattttgccgagcttgcaagagatccaagttcaactagacttgatcttacaaattatgttgattatgtatattcgggcgcttctggtattgttaagccggaagatatggttgtagatcttgggataaataattggagcgttttacttactccttctgcaaggttgcaggcttacgttaaaaattcagttgttgcgcccgctgttgttaagagtgagtcaaaaaggtacgcaggtgatactattttaggggtaagagttttgtttccaagctattctcaatcatctgctatgattatgccaccatttaaaattcctttttattcaggggaaagtggcaatcaatttttaggcaaaggtcttattgataacattaaaaccatgaaagaaattaaggtatctgtttatagtttagggtatgagatagatcttgaggttttatttgaagatatgaatggcatggaatatgcttattctatgggtactttaaagtttaaagggtgggctgatttaatttggtcaaatcctaactatattcctaatatatcatccagaattattaaagacgatgttccaaattatcctcttgcttcaagtaaaatgagatttaaggcttttagagtttcaaagtcacacagttcaaaagagcaaaatttcatcttttatgttaaagatttaagagttctttatgataagttgagtgtttcaatagattctgatattgacagtgagtctgtatttaaagtttatgagactagcggaactgaatcccttcgtaaattaaaggcacacgaaacttttaaaagagttttaaagcttagagaaaaaatttctatgcctgaaggctctttccaaaactttgtagaaaagattgagagtgaaaaacctgaagaatcatctccgaaaaattag

SEQ ID NO: 565 - DNA, 1911 bp, Borrelia burgdorferi
gtggttagtatgaagcttaaagctaggatgttgctacttgttcttattctgatagcattctttatatcaattttgttttttgcttttggaatgcttattaatagtaaattggtggatcaacagtttaatcttatgataaatcttattgaaagcattaaaagttcttttaatctttacatctcttcaatggaagagaaagttagggttagttccatgtatttcaactctgctgaaaaatttaatgaggctagtaaaattaaatccaaaaggttgagctttatttcagatcaatctgaaattcttattcaaaccggtagtaatatgatggttacagacaaagaaggtaaaatagtgtttactacggcggttaaggataatagtgattttggcaaatctattggggatagagaatattttacaaaacttaaggagtctaatagtattgtttacaattcctttgtcatgttggcagatcccgggtctattgaggagtctttacttaaagatatttccaagataaaaaataaaaaaggtcagattccttacatattaataggtatgccattaagagattttgaaacagataacatttttggttattttatgtttctttattcaatggattatatatataggtcttttagagggattaattttggaatactctctagcggtcgtgcgctagcttatgatactacgggtagattgttggttcatcatgtagtattgccaggtgatattttgactgatattagtgcttcttattccaatattattaagaaaacatctgaagatttgttgcaaaagaataaagaaatttcaactgtttattattatgatcctaaaagcaataagaaatatgtgggaattagtcaaaaggtgttattaaacttgtctaataataaatttattcttttaatgagaacttcagaggacgatttttattacatgtcacgagctacaactataatcttagcaattagttttgtatttacattacttatgcttgctattgcaactctttatcttgtgaaaaagttaagctcttctttgaataagatactggaatattctgagagacttgcttctggtaattttactgctgatattaattttggcaaatgggatactgtagagctttacagtttgtacgaagggcttgagcagttgagaaccaatttttcttcagttgcaaaaggagttattgaaaatctagattatctttatgaaaatgcaattcaaatagcaaatgcaagccagaatttaagttctggcgctgttgagcaggcttctactttagagcaaatgacagcaaatattgagcaaatttcacaaggtgtttctgagaatactgaaaatgcagctactactgaaaaaattgctgttaatactaatgaaaggactaaagaggggcataaatctgttgttaaggctattgaggcaatgactgtaattactgaaaaaattggaattattgatgagataacaaggcaaaccaatttgcttgctttaaatgcctcgattgaagctgcacgagtgggagaaaagggcaagggatttgaagtggtagctgctgaggttagaaagcttgcagatcaaagcaaagaatcagcaagagagattattgatattgcaaacagaagtttaactgttgcaagtcgtgctggggaaaattttgaacaaatagttcctggtatggaacaaacagccagacttgtaaaaaatatttctaatgaaagttataagcaaagtgttcaaatagagcaatttaaaaatgcaatagagcaggttagtcagttagtccaaactacagcctcaagcagtgaagagctttctgcaatgtctgaaaagatgttagagagtgtaaaagatttaaaagaatctgttgattattttaagatcgaaaagtaa

SEQ ID NO: 566 - DNA, 1074 bp, Borrelia burgdorferi
ttggacttgttagatttactagaaaaagaaaagcaaattaataagaacaaaggagtgtttatgacaaaaccaaaaatattctcaatcaataaagaaaaaataaaaatattgataatagtagtgttaacatctacattcttattgggaataattttttcaaatgaaaataaagtagcaaggatccttgaagaaaaattttttgattttgactttaatttaatttctaaaattgaaacagagcttgaaggaacgctaacaaaacttggcaaagattggattttaacatacaataaacaaaatattcctgttgataacaaaaaagtcaactctctaatcaaagcattagacgagcttcaaaaaaacaagcttgtaagtagagatcaaaaaaaacacaaggaactaggaattggagaaaatccaagctttaaattatttgacaataataataagctgttaacagaaatttttgttggaaaatcaggagaaggcgattcaagactggcatacattaaaggtagtgacgaaaatgtttacttaacaaaaaacattttcttatcatacaaaggaaattcttacaatacattttcagatactacattgttccaagaaaaaaacacaaaattagaaaatttatcattcaaaataataagaaaattaaacaaggaaaatgaaaataacataaataataactatgagattatcagtaaagatggcctttattttttaaataaccaaaaaatgacaaaagaaaggcctttaaatattattgctgaatttaaagctgacggacttgaaattgataaatctaaaatagatgattataatcttcaatacaaaattgaagtcaaatggagcaataaaagtgtcaataatattgaagtttattttaataaaaacgaagaaaatgacaaagacatattaatcaaaaaagataaagatgaatattactacacgactagcaaatggactttttttgatgtattcgacttagaaaaaaaattaacagaaaaagatgatatttctagcaacgataatcaagaagatcatcatgaacatcacaacaatgcagattaa

SEQ ID NO: 567 - DNA, 798 bp, Borrelia burgdorferi
atgatgagagcattatggacagcagcaagtggaatgactgcacaacaatacaatgtagatacaattgccaataacctttcaaatgtaaatactacaggatttaaaaaaataagagcagaatttgaggatctaatttatcaaacccataacagagcaggaacccctgcaactgaaaatactttaagaccacttggaaatcaagttggtcacggaacaaaaattgctgccacccagagaatatttgaacaaggaaaaatgcaatccacaaatttactcactgacgttgccattgaaggagatggattttacaaaattcttctacctgatggaacttatgcatatactagagatgggtcatttaaaatcgattctaatcgagagcttgtaacaagccaaggatacaaagtattgcctaatatactcttcccagaagaatatatccaaaactcaattacaatatctgaagagggaatagtatcggtaaaaattgataccagcaacgaaccaatagagcttgggcaaattgaaatatcaagatttatcaatcctgcaggactaagtgccattggaagcaatttatttaaagaaacagctggatcaggccaagaaatagcaggaataccaggaagtgaaggcatgggaagactaaggcaaggcatacttgaaatgtcaaatgtatctattgctgaagaaatggtaacaatgatagtagctcaaagggcttatgaaataaactcaaaagctattcaaacttctgacaatatgttaggaattgcaaataacttaaaaaggcaataa

SEQ ID NO: 568 - DNA, 1410 bp, Borrelia burgdorferi
atgaaatacttttattttttattttttttacttatttttaatgtgtatgctcaaaatgttaattctccagctcttcctagtccgcctttgttgcccgaaattacagaaaataagcctgttgagagagaaaattcttctaagggagagaatttttctaatgttggtttagatggtaagtatgttaacgatacaattctttatgggcttgatagtcaagtgacaagcattataaaagctcttaaaaaatcaagcgatagtcaatataatttttctcttaaaaaaagacttgagaaaacttttaatgctgagcttaaaagggaaatacttgaattgtttatttctcttaagtattcggggggcattgatacagcaaattatattcttgaaaattatgagagtaaaagatattcaaacgctttatttggcttggcaatttcgtatcttaaggagtttgatgataaagaaaaattaaaaaaaactcttattgacattcttgaaaataaagagggcaatgtggtatctattgcagcttattatttaggagagcttaattctcttgagtattctaaaaacatgatggaagtttttgaaaaatattctggaaatgatggggctagaagagaaatacttattgctcttggaaaaatgtccgctgttgattatcaggatagaatttatgaaatttcgctagataattacgagggcccatcaattaaggctgctgcaatcgaagcgttgtcatatcttgcttcagataaagtaactgaaaatgctgatttgtatcttcagagtaataacaataatttaaatgttaaattagctattattgcttctttgtccaaagatccttctttaaagtctaaagagattttacaaggatttttaagagattctgatgataatattaggtttaaagctattaatgcaatcaaaggacatagggactcttctgcaaaggatattttgatttataagcttaaaagcgatccatctcttaaagttagggaggcttctgctaaggccttaattgatatggatcttgggaatattgagataaaaaacattatgtttgattttaagattgacaataattttaaaatttcaatgtttagttaccttttagataaggattctctaaaagcattgtcaattgctttagaaattgttaataaagaaaatattaatagaccctcaaatgttttaaggggcgttgcttcaatgttggctggtaaaaagggtaattttgataatttttattctaaaatcattgacagcaaaaatattgatttaaggcatttagcattaaaaggagctgtttataataaatcttcatcgctttctgataagcttaaaaaaattaaaagtgaaacgaactccgaatatattaaaatgcttttaaaagattattga

SEQ ID NO: 569 - DNA, 972 bp, Borrelia burgdorferi
atgaaaaaaaaaaatttatcaatttacatgataatgctaataagtttattatcatgtaatacaagtgaccccaatgaattaactcgtaaaaaaatgcaagacaagaacgtgaaaattttaggatttttagagaaaattcaagcagataataaagaaattgttgaaaaacatatagaaaaaaaagaaaaacaaatggtgcaggctgcttctgtagcacctattaatgtagagagtaatttcccatattatcttcaagaagaaatagagataaaagaagaagagttggttccaaatactgatgaagaaaagaaggcagagaaggcaattagcgatgggagtcttgaatttgctaaattagttgatgatgaaaataaacttaaaaatgaatctgcgcaattagaatctagttttaataatgtttataaagaaatcttagaacttgcagatttaatacaagcagaggtgcatgttgcaggaaggataaatagctatataaaaaaaagaaagaccactaaagaaaaagaatataagaagagagaaattaagaataagatagaaaaacaggctctaattaagttgttcaatcagttattagaaaaaagaggcgatattgaaaatcttcatactcaattaaatagtggacttagcgagagagcatctgcaaaatacttttttgagaaagccaaagaaactttaaaagctgctattactgaaagattaaataacaaacgtaaaaatcggccatggtgggcaagaagaacacatagtaatttagcaatacaggcaaaaaatgaggcagaggatgctttaaaccaattaagtacttcttcttttaggatacttgaagcaatgaaaataaaggaagatgtaaaacagcttcttgaagaagtaaaatcttttctagattcttcaaagagcaaaatcttttctagtggcgatagattatatgattttttagagacgagtaaataa

SEQ ID NO: 570 - DNA, 510 bp, Borrelia burgdorferi
ttgaaaaaaacgattattgtatttataatattagcatttatgcttaattgcaaaaacaaaagtaatgatgccgagccaaacaacgatctagatgaaaaatcgcaagccaaatcaaacctagttgatgaagatagaattgaattcagcaaagcaacacctttagaaaaattagtaagcagattaaacttaaacaacacggaaaaagaaacactaacatttttaacaaacttattaaaagaaaaactagtagatccaaatattggcttacattttaaaaatagcggtggagacgaaagcaaaatagaagaatctgtacaaaaatttctatcagagctaaaagaagatgaaataaaagatctgcttgcgaaaattaaagaaaataaagataaaaaagaaaaagatccagaagagctaaatacttacaaaagcatacttgctagcggatttgatggaatttttaatcaagcagattccaaaaccacacttaataaacttaaagacactatatag

SEQ ID NO: 571 - DNA, 849 bp, Borrelia burgdorferi
ttgaaaagagtcattgtatcctttgtggttttaatcctagggtgtaatttagatgataattcaaaaatggagagaaagggtagtaataagcttattagagaaagtggatcagataggcggggtcaagaaaatagagccttgggggcgatgaattttgggcttttttctggagattctggtgtagtttatgatttgcaaaattatgaaactttaaaagctcttgaaaataaaaataaatttattgattactctaaaatagagtttttagaaggaacaaaatcaataaatgcttttatttgggcagtttctgttcgttggataaaaattaaagccagagatttgtttggggagtgtggagattttattaaagagcttaagggcattaagtattcttatcttgtttctcctgttgatggaagctatatttcttatgccatgcctataatagtttttgaaactactagagagagtgatccgctttattctgtttctgggtttaaattaataagcaagggaaatgatataaattttaatgaaaataaaagcggattttggggaagacttccaatgtctgaaaaatcagttgaatctgggcttgtaaccgcatatccttttggttctagcgatgctaaaaaagtgattgaagcttttgcttctctttataataatggaacttggagtgatatgattgccgagattactattaagtcaaagcaatatccaaaaaatgaaaaagtttacagaattacgcttgattctcagctttttaatgttgctatgaaaaaaataattgaaaaatatcctaaaataaaaagtgcaagttttgcatttaattcgttaattaactaa

SEQ ID NO: 572 - DNA, 489 bp, Borrelia burgdorferi
gtgtgtgggagacgtatgaaaaatattttattatttgttattttattattcttttcttgtaaagaatttaattattctgatcttaggagaaggccttcaaaggttttaaatgcttctaatggtgcatcaaataaagaacttaaaatttcttttgtagattctttaaatgatgatcaaaaagaagctttgttttttcttgaacaggtagttcttgatagcaatcccgacaagtttaatcaaatttttaatttaaatgaagagaaggtaaaagaaatgcttgttactgttgttaagtgtttaaaggccaaaagaaaggctaaaatggctcttgagagctcaaatgttgcaaatgttgccaatgctaaacagcaattgctacaggttgaaaaaacttacatagataatttgcgacaatcttttatgactactaaaaacattgaagaggcttgtaatcttgtaaaaaattatgatgcatctgcttcgttttaa

SEQ ID NO: 573 - DNA, 822 bp, Borrelia burgdorferi
atgaaaaaatatttattgggaataggtctaatattagccttaatagcatgtaagcaaaatgttagcagccttgacgagaaaaacagcgtttcagtagatttgcctggtgaaatgaaagttcttgtaagcaaagaaaaaaacaaagacggcaagtacgatctaattgcaacagtagacaagcttgagcttaaaggaacttctgataaaaacaatggatctggagtacttgaaggcgtaaaagctgacaaaagtaaagtaaaattaacaatttctgacgatctaggtcaaaccacacttgaagttttcaaagaagatggcaaaacactagtatcaaaaaaagtaacttccaaagacaagtcatcaacagaagaaaaattcaatgaaaaaggtgaagtatctgaaaaaataataacaagagcagacggaaccagacttgaatacacaggaattaaaagcgatggatctggaaaagctaaagaggttttaaaaggctatgttcttgaaggaactctaactgctgaaaaaacaacattggtggttaaagaaggaactgttactttaagcaaaaatatttcaaaatctggggaagtttcagttgaacttaatgacactgacagtagtgctgctactaaaaaaactgcagcttggaattcaggcacttcaactttaacaattactgtaaacagtaaaaaaactaaagaccttgtgtttacaaaagaaaacacaattacagtacaacaatacgactcaaatggcaccaaattagaggggtcagcagttgaaattacaaaacttgatgaaattaaaaacgctttaaaataa

SEQ ID NO: 574 - DNA, 891 bp, Borrelia burgdorferi
atgagattattaataggatttgctttagcgttagctttaataggatgtgcacaaaaaggtgctgagtcaattggttctcaaaaagaaaatgatctaaaccttgaagactctagtaaaaaatcacatcaaaacgctaaacaagaccttcctgcggtgacagaagactcagtgtctttgtttaatggtaataaaatttttgtaagcaaagaaaaaaatagctccggcaaatatgatttaagagcaacaattgatcaggttgaacttaaaggaacttccgataaaaacaatggttctggaacccttgaaggttcaaagcctgacaagagtaaagtaaaattaacagtttctgctgatttaaacacagtaaccttagaagcatttgatgccagcaaccaaaaaatttcaagtaaagttactaaaaaacaggggtcaataacakaggaaactctcaaagctaataaattagactcaaagaaattaacaagatcaaacggaactacacttgaatactcacaaataacagatgctgacaatgctacaaaagcagtagaaactctaaaaaatagcattaagcttgaaggaagtcttgtaggcggaaaaacaacagtggaaattaaagaaggtactgttactctaaaaagagaaattgaaaaagatggaaaagtaaaagtctttttgaatgacactgcaggttctaacaaaaaaacaggtaaatgggaagacagtactagcactttaacaattagtgctgacagcaaaaaaactaaagatttggtgttcttaacagatggtacaattacagtacaacaatacaacacagctggaaccagcctagaaggatcagcaagtgaaattaaaaatctttcagagcttaaaaacgctttaaaataa

SEQ ID NO: 575 - DNA, 564 bp, Borrelia burgdorferi
atgaaaattggaaagctaaattcaatagttatagccttgttttttaaactattggtcgcatgtagtattggattagtagaaagaacaaatgcagctcttgaatcgtcctctaaggatttaaaaaacaaaattttaaaaataaaaaaagaagccacgggaaaaggtgtactttttgaagcttttacaggtcttaaaaccggttccaaggtaacaagtggtggactagccttaagagaagcaaaagtacaagccattgttgaaacaggaaagttccttaagataatagaagaagaagctttaaagcttaaagaaactggaaacagtggtcaattcttggctatgtttgacttaatgcttgaggttgtagaatcgctagaagacgttggaataataggcttaaaagcccgtgttttagaggaatctaaaaataatcctataaacacagctgaaagattgcttgcggctaaagctcaaatagaaaatcaacttaaagtggttaaggaaaaacaaaatattgaaaatggtggagagaaaaaaaataataaaagcaaaaaaaagaaataa

SEQ ID NO: 576 - DNA, 1590 bp, Borrelia burgdorferi
atgataataaaaaaaagaggacttttaatactgggcattgctactgtaatctcgtgctcagcaatgtctaaaccaaaagatgatattgtctttggtgttggaattggaaacgaaccaacatcgcttgatccacaattttgcagcgataggctaggtaatttaattataaacgaactatttgtagggcttttaaggggtgaccccaaaacgggtggatacaggccaggacttgcaaaaaattgggacatttcttacgacaacacctgctatacattccatttaagagacgacatttattggagtgacggcattaaaataacagcaagcaccattagagattcctacataatggccttagaaaatgagcttgatgtgccacatattaacctattaacatcaaagataaaaaatgcacaagaattttacgaaacaaaattaaatgcagatgaagttggagtaaaggtaatcaatgagcaaactttagaaataactctctctcgcccagcaagatattttcttgacatgcttacacacccaatatttatacccattcctacgcacattgttaaaaagtttggaaacaaatggacaagctcagaaaacatggttacaagcgggcctttcaagctaaaaagaaggatcttaaacgaagaaatatctcttgaaaaaaatgaaaaattctatgatgctaaaaacgttgctattaatgagctcatatttgttactataaacgacacccgcagaatttacagtatgtacgagcacaacgaaatagatgctatttttaataacatccccttaagccttattaatgagcttatcttaagagaagatttttattcagctgacattaatcaaattgggtttttttcactaaacacaaatgttaaacctcttaacaatgtaaaagtaagagaagcattggctcttgcggttgacagagaaactctaacttacagagttcttgacaacaactttaaagcaacaagaaaaataagccctaatattaacaactataattatgggaaaaagcttaagccatacaacccgcgaaaagcagaaaagctcttagccgaagctggatatccagatggtaaaaattttccaactcttacaataaaatacaataaaaatgaccttgaaaaagaagttgctagttttattcaaagccaatggaaaaaagttttaaatattgatgtagaaattgagcctgaaacatgggtcaaccacatatcaaatattttaaaaggtcaatatgagatctcagtaaggtcctggcaaggagattatttagatcccatggcattctttaatatatttgaaactaaaaactcacattttgcatcttacggatattcaaatcctgaacttgatgagcttataataaaatccgatcttgaagaggatgaaaaactaagattagaaatattaaaaaagatagaagaaataattattgaaaatgattatccaataattccaatatacagtgttgcgggaaactatctttttaaaaacgacaaatggctagggtggaatacaaacaattcagaaagatttgccctatcagaaataaaacctatagaagaataa

SEQ ID NO: 577 - DNA, 642 bp, Borrelia burgdorferi
ttgatgcaaaggataagtattttattaatgttattggcggtgttttcttgtaagcagtttggcgatgttaaatcgcttacagaaattgattctgggaatggcatccctcttgttgttagcgatgtagttaaggatttgattcccaaagagatttctttaactcccgaagaagctgaaaagctagagtctttaaaagtctttttaaaagatgcaatgagtgttaatggtagagaagaagctttaaaagctgagtacgaaaaatcttataaagaattttttgattggctttctaaggatgttaacagacaaaaagaatttataagctcttttgacaatatttctagcattgtttctaaagcagtagatgcaagcaaaaagcgacgccccactgagcaacaatctttaggctttaaagaatatgtttgctataaaattaaaaatagcaaaggggaggctttaagtttatttttccaaaaggtagttgatgcatttggtgctgatccttacaaaaaagataatgatgagagtgttcaaaaacctgtaaaatgcaatgaagagatttttaaagtaattaaaaaagtgcttactgaaagcgagagtaacaacgaattgaaaaatttgaaaaattatggaaatgtttaa

SEQ ID NO: 578 - DNA, 609 bp, Borrelia burgdorferi
atgagcgattcaattgattttcaaaaagagatagaaaagctaaaagcatcaaaagtagaacttgagagccagcttgaaagtttaaagaaaaatcaagctcaaaaaattgttttagacaaactgcaaagcgttaatgctagcagttacccggtatttgagagccacaaatttcaagacgaagggctttattttgctcaaaaaggcggacttaaaagctcttctgctgataagtttgaaaattatcaagctttagatttttgctacaaatgcggagttaagcttattgttaacggttcaaatttgcaaatagcaaaaggcggtggtagtgatctttatggggtttgtgtagactttgacgatttttcaagaaccggcacggttgttccaatcacttgtagttttgaatgtgttttgattactaaagacaaaaccatcaaagcagaagacaaattaataataaacagcgaaggggttttagaaaaatctagcaaaaatgcatctgttattcacgctttagcattaggtcctgctttagaatttaaagacagaagagatgtttatggagttagagttctttttttagtcaagcaaataaaagattcaatttaa

SEQ ID NO: 579 - DNA, 489 bp, Borrelia burgdorferi
atgagatacaagttaaaaatattaaccagagccaaaacacatacatacgttttaaaagatattcccatgtacgattgggacagcgttttaggatttgacgttgaaagagatgagcttattagcaagcttaatgatctgcgaacattaaaagaaataaccaaactaatgatctcaagaggttttttagatgaattttacgaaattttaaacaaagagagaagatattctgagctttacaagtacgctcttcccacaattcttttttcagttcagtattcactttttgaaacaattgaaggttttaaaaagcccgggttggtttacattgaaagttttcaagataaaaacggcgactacattaagtatgactacattaatgagcgctggagttatgatttaatcacaaacagcaagccttcagacttaaactcagaagattctttagagcctggttttgagtctttgttgcaagaaggtagcaatgaataa

SEQ ID NO: 580 - DNA, 1245 bp, Borrelia burgdorferi
ttgaacggcaagcttagaaaagctttaaaaattgcaatatttacaacattgctgctagttattagctgtaatgcaaatatggatacaaacgataaaaacaaagccttaaacgaatataaattaaaaaatatttcagaagtcattaagaacagcttgcagcttgaatcagaccctaaattaaaaaaagaacctgaatcaaacataaatcaaagcacaccccctattttagaaattgaaaaaatcgaacctggaaaacaagagatgtccttaaaatctgaatttggcagcgaaagcttaatgccactagaagaaccagaagaagcaaatatggcaaaatcagaagaagaaattgcaaaaatacaagaaaaattattgttaattggagcttctgacgagatcacagatcaagaattgggcgaaaatatgcaaaaatttttaaatccaactacagtagaatttaaaatttcaacaaccaccaacgaaacaatacttaccacaattgaagaagaagaaattaataacaacaaagacaaaatttttgaccacaaagaagaaaatgtcactttaggaaataactctttagaaaatgcaactttaaacaaaaacacaataaccttagcacaaaaccaaaaatacaccactcacttaaaaaatgatgacaaattcataacaaaagaatacttaaagcaagttagagactctctagataaagcgctaaatgcaataaaaaatttagaaacatctaaagaatttagagagcttgaaaatttaccaaaggatcaagaaaactctccaagcgcaaaaaaagaatcaactgagagcaacattaataatactaataccgagaacatagaaataataaaaaacagattgctcgaagagctaaacaaaagtgagcttatttttgaagacactaaagatcccctaggaacaagcacaataaaaaaggtcatagatgctgctaaaaaatggcaggaaaaagaaaattcaagtcaaatagactgggacttgggctttaagtttcacccaaacccaaaattttacaacaaattgacagctcaagaatataaagttttggctgaaaaatttactaaagttaaaaatgaatacaaaaacacaaaagaacaactaaaagctgagtccaaattaacaaccaacagcatcagcaaaataattaacgcaacaaaagaatttgcaaaccaggtaataaacttaatcttattggtagaaaaaaattatcaataa

SEQ ID NO: 581 - DNA, 126 bp, Borrelia burgdorferi
ttgctccaattcagtaatactggttttgcattcaaaaggggggagaggggtttaaaaacctctttccccttttttatatttaattttaatattaatttaatttttctaaatcaaaataataaatag

SEQ ID NO: 582 - DNA, 924 bp, Borrelia burgdorferi
ttgaaggataacattttgaaaaataataaattaattgcaatatttttattgcatgtattaactgtgctaattttgatttcttgctctctggaagtcaaagacagcaatgaaagcaaaaagcataaaaaagagaaaaggaaaggaaaagtagaaaatctgcttgttgctattaataatttaaaaaatccaacaaagcccgcagctggaaaaaataaagcaaattcaaaggcttcaaaacaaaaaaataatcccaacgctaatgccaacaatgctccaaaaaaaatattagatcctgaagttgcaaagctaatacaaaaaatactggacagatctgagaatattattcaaataagcgaaatggattcttccaggggtgaacctaatgaccaatttggaatgagagcagaaatatttagtaaaatatttttcaatgcaaactcaacagtgcattttgacagccacgaatatacagaagagagaaggatgctttacacatctttaaatttcaacgaaggaaaaatttttaatcttgggcaaattttatcaaaactcagccaagactcaaactacagaggtttggttaaagaaactcttataaacagaggctttagcattcaattagcaatggaagaaatcagcgcaaaaatactaaatgtaaaagataaactacaacagctaaacaaacctaatttggaaacactctacaatgattttgaaaaacttacatcacttaaagaaaaatggctaaaagacacagatgaccttattgacgagtacaatactaaccctgacttacaaactgacgtttcaaaattaaatgacaccttaagatcaaaaaattcaagagctcaatttgcaaacattcacgatataattttggacttagtaaacacgactaccaatattcttgctccaattcagtaa

SEQ ID NO: 583 - DNA, 1038 bp, Borrelia burgdorferi
atgaaataccttaaaaacatttccttatttttgttaattttaggttgcaaatccatcccaaatggtaatttcaatctacacgatacaaaccataaattaggaaaactaaaatttcaagaagactcgataataagcagaaattatgataataaaatatccattgtgggagtatacaaccctttaacagaaaaagaaaattttaaagtcaatattttcatcaaaaaaaaaggattacaaatagatcctgaaaatattttgataaatgaagaaaaaattaattattcaaaatataaagcagaactcaaagtaaaatctagctttaataaaagcattatcagtatttcactaactaattcaagagatctattaacctacatttacgataaaagcacagggaaatacattaacattgactttaaggacaattggaacgtatcgcacagtataaaatttaataaggagtatattttagcatatataacagattttgataaagaaattaaaatatctaaaaatattttgcaaaaacgtattgataatagaaaaattgaaattgaaaaaacagagcttaaaacagaatataatgaaatagaggattattacatctacagtatgaaaattccaaaattatttgaaaaatcagacgctccctctgaaacttacgaaacatttgttatagcaaattattacccctgtgaaaatttaaatatactgtttttgaatttaagcttatactctgataaattacgctttctaaactctatttatgatgagaatgatagaaaattaaaaatggagcctcctgtgagagccttaaagaattcaaaaacaataaaagaaacattaaatatagtattaagtcctcaaaaaataatagagctagcaaaaaacattgaaaaagatattactctaaaattaaaatcttacggagaaaagggagaattcacatttgaaatatataaaccacttcttttaaaattcttaaaagaagtagatcattgcataaaaaatttgcaatcaagtaggcataaattttaa

SEQ ID NO: 584 - DNA, 498 bp, Borrelia burgdorferi
atgatattatatcaaaatcaattaaaatttttaaaattgttggtattttttttattaatatcttgcacttccttaaacgttgagcacgatcaatttggaaaaacatttagaatataccaaagcttaaataaaaatgcagaacttaagggtatttttaattataaaacaggaataactaaaatagtattatacacaaggtttagaaaccatagtataacagaacagaatcctttattgctgctggatggaactaaaattgagggaaaagtaagctacaaaagagataataaccatttttttggcaactggattaattattcatcatttgttttgaccaaatctttattggaaaggatgattaaagaagaagatgcttcttataagaataaggaggttaaaattagaattggattagaagatttaagcttgaaaaaatataaaattttggactttctagtaatggttgaatcgattgaaaataaagattataaaagttaa

SEQ ID NO: 585 - DNA, 1593 bp, Borrelia burgdorferi
atgaaaatattgataaaaaagttaaaagttgtattatttctcaatttaattttacttatttcttgtgttaatgaaagtaatagaaacaaattggtttttaagctaaatattggaagtgagcctgctactttagatgctcaattaataaacgatacggttggatcagggattgtaagccaaatgtttcttggcattttagatggagatcccaggactggaggatacagaccgggacttgctaaaagttgggatatttctgatgacggagtagtttatacgtttcatttaagagataatcttgtttggagtgatggagtttccattactgccgaaggaataagaaaatcttatcttagaattttagataaagaaaccggctcatcttttgttaacatgattaagtccgttattaaaaatgcagaagagtattttgacggcaaagcaaatgagtctgagcttggaattaaagctcttgatgaaaaaactttagaaataacgctaaaatctccaaagccatattttcttgatatgttagtacatcaaacatttattcctgtaccaatgcacgttattgaaaagtatgggcaaaggtggacagaccccgagaatatggttgttagtggtcctttcaaattaaaatctagagttttaaatgaaaaggttgttcttgaaaagaataataaatattataattccaaagatgttgttcttgacagtattatattttttgtcacagataatagcattacagcttataatatgtatttaaatgatgagctggatgcaatttttaagaatgttccaccagatttgcttaaggatcttaagcttagggacgattattattcaatgggtattaattcaacctctttttattctttgaacatgaaagtaaaaccgcttgacaatgttaaagttagaaaggcgctgtcttttgctattgatagaaaaaccttaacagagagcgttcttaatgatagttctattcctacaagaagagcaactccagattatattgattactcttataaaagcaatttgagcttatttgatgctgaaatggcaaagaagcttttggcagatgcaggatatcccaatggtaataattttcctttattaaaagtaaagtacaatacaagtgatagccagagaaaaattgctgaatttattcaaaatcagtggaagaaaaacttaaatattaatgtacagcttgagaatgaagaatggtcaacatatataaatagtagagtaaatggtaattatgaaataataagatcaggatggtcaggagattatgctgatcctatgacgttcttaagcatctttcaaactgaaaatacatctttttcatcttatggatattcaaattctgaatatgatgaacttttaataaaatcagataatgagagagatatttttaaaagacaggaaattctaaaaaaagcagaagcaataataattgaaagagattttccggctgtatttcttaatataacttcttctagttatctttttagaaacgacaagtggaaaggttgggagccaaatatttcggaaagatttaatttatctgaaataaaaccaattaaatga

SEQ ID NO: 586 - DNA, 528 bp, Borrelia burgdorferi
atgcaaaaaataaacatagctaaattaatttttatattaatattttcattatttgtaatatcttgtgaactatttataataaaaaggagagcaacaattacagaaacaacaacaatagaaaaaaaaagaataaattggcttattatgagtgtctcaggccttaatgatgaggccgatgaagttgcatttaaacattgtagagaaaaaataagcttattaaaagaagacttaaaatatgcaactaatgctaaagaattcgaagaaaaatttttaaatttacaaaaactttttcaagaaaaactaacatccaaactaaacgccttaaaagcagtaagagtagatatccaaagatttaatgcaaacgataatgatgatttagaaaagaacaaactcaaaatacgctcaatagctctatcagccggagtaaataccagtcctattgcactccatgctattaacataaaagaactatctgaagacgtagtagcacatatagacagtataataaaatatcttgaagaagattaa

SEQ ID NO: 587 - DNA, 864 bp, Borrelia burgdorferi
atgcaaaaagacatatatatttcgaatatatttttatatataccattattttattcgtgttttttgacgccaccaaaatctttaaaaatcaacagtatcaaaactgaagtttttgattttaagataattgaagagggggatattacaaaatataataaaaaccccattaaagagagtaacaataatatttgtcttacttttaaggaacccgaattaaatgaaataaaagaaggagaggtgtttgaaatacttgcaaatggttatgttacatgggcaaaatctggtgatttaagagatataaaagataaaaataataatttaattgaagatcttagagagcttaagtattcttatattttttcacccatccgattcaaaacttattcattgcttacctttagctatactaattatagcattaatgacaataactataaaatattcggtcaagaagtacctatagctaagataatagcatttgaatcaactgaagagtttgaaaaaaaatatgaaatcaaaagtttaaaactaaattctgaagagtcgaatattgattttgaacaaaatagaactggttttgccaaaatcaatttaaaagaaacttcaagggaacctcaatacatttattcatataattttggggtttttgacaattccttagcagattattttaagctcttttacaagaaaagtaaatgcaactatatgcctgcatatcttactataaaagataaacaaacaaataaagataaaacctacgaaatcatattaaatctaaagctatttaatgatgctattagattaatatttgataagtattcaaatttatcaaaagaaaaattaaaactttttattgatgaatga

SEQ ID NO: 588 - DNA, 522 bp, Borrelia burgdorferi
ttgagtatggaacaactaatagctcaagatttgtcaaaaagatattattacaatgaactaacatatagagatttagaaaatttagaaaagcaatttggtataaagtttgacaatcttgttactaagattgataacgtagaaaagaatttaaatctaaaaatagataatttagatactaagattgatactgttaaaagtgaacttactactaagattgatactgttaaaagcgaacttactactaagattgataacttagaaaagaatttacaaaaagatatgtttaatttggaacaaaggctagaagcaaagctggaagccaataacaaagttcttttggaaaaactggaatccaataacaaagttcttttggaaaagctggaatccaataacaaagttcttttggaaaagcttagcgtgaaaaacagagtgtcagttgttattgcatcagtagtttcgcccattgttttatctattttgtcgtccttaattatgacattaattggcaactatttcaagtag

SEQ ID NO: 589 - DNA, 894 bp, Borrelia burgdorferi
atgagaaaaagtttgtttttatatacattattaatgggaggattgatgtcttgcaatttagattccaaattatctagtaacaaagaacaaaaaaataacaataatgtaaaagaagtttcgaatagtgttcaagaagatggtcttaatgatttatatagtaatcaagaaaagcaaaaaagctttactaaaaattttggagaatggaaatatgaggatttaattaatcctatagagcctataataccttcagaatcaccaaagaataaggctaatataccaaatatttcaattgtgcatactcaaaaaaaagagataaaagaggaggatttaatcccttctactaatgaagaaaaggaagctgatgaagcaattaaatatttagaagaaaatattcttcaaaactctaaattttctgaattaattagagaagtacgtgtacttaaagatgaatatgctttaataaactctgatttttatgatgtaattgaaaagattcacaataaaaaaacatcattaatggaaaattataagaacaatagagataagataaataaattaacactgttgcaaaataatttaaagataaatattgaacttgagcagcttataaatatgattgatattgcagaaaatgaaataagatctgcggctttcttttttgacaccgctcagaaaaggttaaaagaaagtattattaaaagattagagagtaaaaataatagatcttattatgcattagaattgtctagacaggctttaagtgacgcaagaagtgctttaagcagtttagaatcttttgcttttaaaagagctgaaccaatggtaagaaagaaaaaaataaaagagcttattaaacatgcaaaaactgttttagaaagtctcaataaaaaataa

SEQ ID NO: 590 - DNA, 510 bp, Borrelia burgdorferi
atggcagatttcgattttacaaaattatgtaaaaatttcgttttaggagttgaacacaaagcatgcgtacatcaaactgaaaccgcaatagttgatgttgaatcacccatcatcaaaccgggagatccagtttattcaagtggatcaagtgaaatgggagaagtactggtaaaggctgcaactgcaacagcgggagttggtcctattcgtggatttgccttaaaaaaggcagatattgctttactagaaagtgaaaattactcaccgggcgaactaattccaataagacgtgccggggaaataaccgttatgttagataacacatttgcaactcctaaaattggtgattttgtcttcttaaagggggggaaacttgtaaaagacggcaaagggggtgtgcaagttgggagaatcaaagatgttagtcttgatgcaaatagcaaagtagttttgcttgatgttaatattggccctgagtttgagtctaatggtaacagaaaatttgcatga

SEQ ID NO: 591 - DNA, 801 bp, Borrelia burgdorferi
atgaaatcatcagtagtgacaacaagtattactgaagagcaaatatataaagagtttctgcgactaggtatggaacaactaatagctcaagatttatcaaaaagatattatcacaatgaacttacatatagagatttagaaaatttagaaaagcaatttggcataaagtttgacaatcttgttactaagattgatactgttaaaagtgaacttactactaagattgataatgtagaaaagaatttacaaaaggatatatccaacttagacgttaagattgatactgttaaaagtgaacttactactaagattgataacgtagaaaagaatttacaaaaggatatatccaacttagacgttaagattgatactgttaaaagtgaacttactactaagattgataacgtagaaaagaatttagatactaagattgataacgtagaaaagaatttagatactaagattgataacgtagaaaagaatttagatactaagattgataacgtagaaaagaatttgcaaaaagatatgtttagtttggaacaaaggctagaaataaagctggaagccaataacaaacttcttttggaaaagctggaagccaataacaaacttcttttggaaaagctggaagccaatagcaaagttcttttggaaaagctagaagccaataacaaagtttcttcagaaaagcttaaagtcagcaacagaatagttattattgcagtagtagttgtgcccactgctatatctattctaactcccttcattacgtcattaattagcaattatttcaaatag

SEQ ID NO: 592 - DNA, 711 bp, Borrelia burgdorferi
atgaaaaaaagttttttatcaatatacatgttaatttcaataagtttattatcatgtgatgttagtagattaaatcagagaaatattaatgagcttaaaatttttgttgaaaaggccaagtattattctataaaattagacgctatttataacgaatgtacaggagcatataatgatattatgacttattcggaaggtacattttctgatcaaagtaaggttaatcaagctatatctatatttaaaaaagacaataaaattgttaataagtttaaggagcttgaaaagattatagaagaatacaaacctatgtttttaagtaaattaattgatgattttgctatagaattagaccaagctgtagataatgatgtgtctaatgccagacatgttgctgattcttataaaaaacttagaaaatctgttgtattagcctacattgagagttttgatgttatatcttctaagtttgttgatagtaagtttgttgaagcttctaaaaaatttgtcaataaagctaaagagtttgtagaggaaaatgatcttatagctcttgagtgtattgtgaaaactattggagatatggttaatgatagggaaataaattcaagaagcaggtataataatttttataaaaaagaagcagattttttaggtgctgctgtagaacttgagggggcttataaagctattaagcaaactttattatag

SEQ ID NO: 593 - DNA, 669 bp, Borrelia burgdorferi
atgaaagcagttttggcaacgacaaatattaccgaagatcaaatatatagagagtttctgcgactaggaatggaacagttaatagctcaagatttgtcaaaaagatattatcacaatgagcttacatatagagatttggaaaatttagaaaaacaattcggtataaggttcgagaaccttatttctgagatttcttttttagaaaagaatttacaaaaagacatatttaatttagatgctaagatagattctgtagaaaagaatttacaaaaagacatatttaatttagatgctaagatagattctgtagaaaagaatttacaaaaagacatatttaatttagatgctaagatagattctgtagaaaagaatttacaaaaagacatatttaatttagatgctaagatagattctgtagaaaagaatttacaaaaagacatatttaatttagatgctaagatagattctgtagaaaagaatttacaaaaagacatatttaatttggcacaagctcttaaaaaagaagttcaaattaatagtcaatttttattggaaaaactcaaggtgagcaacagaataataattattattacagtaataatagttcccattgctatatctagcataacaaatattgttatgctactaattgctaaattttttaaatag

SEQ ID NO: 594 - DNA, 555 bp, Borrelia burgdorferi
atgaggattttggttggcgtttgtataatagcattggctttattgggttgttatttgcctgataatcaggaacaagctgttcaaactttttttgagaattcggaaagtagtgatatgggttccgatgagattgttactgaaggcatattttctagtttaaaattatatgcgtctgaacatcgtttattggttgagataaaaaagactttaattagtttaaaagatcctaattatcgtggtgtagtactcccagtgagtgactataatgaggagtattttaataaattctttctagatttagggtctgagcaatctaaagacctgattaagttgtttattatggtaaaaaatgagcagaacaataataaatttatgcgtatagttcgttggctgtattcatgtatagaggagttatattctccagatattaagtattctggcgaagaggggagccctgagtattatcgtaatatgcctagacccactgcttatcaacaatatttaaaagtgaagaggtatgattataatagaccagttcctattttacctacataa

SEQ ID NO: 595 - DNA, 753 bp, Borrelia burgdorferi
atgagtaaactaatattggcaatatctatactgctaataatttcatgtaaatggcatgtagacaatcccattgatgaagcaactgcagaaagtaaatcagcactaacatctgttgatcaagtattagatgagataagtgaagctacaggtctaagttcggaaaaaatcacaaaattaactccggaagagctagaaaatttagcaaaggaagctcaagatgattctgaaaaatccaaaaaagaaattgaagatcaaaaaaataccaaggaaagtaaaaacatagaagtaaaggatactcctcgcttaatcaaattgattaagaattcatcagaaaaaattgattcggtttttcaaacactaattaatataggttataatgctacctatgcagccaaaagtaatttgaagaatggactaaagatggtgaaattactggatgagttgctaaaaatatcggtaagtagcaatggtgataaaagtacccaaaaatacaatgaacttaaaaccgttgtaaataggtttaatgctgaaaattcagcgataaaggtaccattagaaaatggtagtaaaattgaagccaaaaagtgcataaaaactcttatgaccaatgtggaaacctatttcaagggcgtgagcaccgaactcaaagataaaaaagacgacaaatatactaaaatattggcagctttgagtgaggcagccaataaaatagagaatgcagcaatggccatacatttgtgctttaataattaa

SEQ ID NO: 596 - DNA, 699 bp, Borrelia burgdorferi
atgagtaaactaatattggcaatatctatactgctaataatttcatgtaaatggtatgtagacaataccattgatgaagcaactgtagaaagtaaatcagcactaacatctattgatcaagtattagatgagataagtgaagccacaggcctaagttcggaaaaaatcacaaaattaactccggaagagctagaaaatttagcaaaggaagctcaagatgactctgaaaaatccaaaaaagaaattgaagatcaaaaaaataccaaggaaagtaaaaacatagaagtaaaggatactcctcgcttaatcaaattgataaagaattcatcagaaaaaattgattcggtttttcaaacactaattaatataggttataatgctacctatgcagccaaaagtaatttgaagaatggactaaagatggtgaaattactggatgagttgctaaaaatatcggtaagtagcaatggtgataaaagtacccaaaaatacaatgaacttaaaaccgttgtaaataagtttaatgctgaaaattcggtaagcgtttcttttaaagaacattcaaacagtaaaattgaaactaaaaaatgtattcaaactcttatgaaaaatgtagaaacatactttgaaggtgtatgcagcgaacttaaaaacaaaaatgatggtgagtacgaaaaaacattgacaactttaagctaa

SEQ ID NO: 597 - DNA, 717 bp, Borrelia burgdorferi
ttgcttttaggaggtcaatctatgtttagaggaaaagaaatatatttcttgttattttcgttacttttgtttatatcatcaattataatttctcacggaataaaaaacattggcaccaaaaatgaaaattatattacggtaaagggtcttagcgaaagagaaattttatcaacgtcttctagttgggggcttagatacagcttaaccggtaacactataaatgatattaataaagcaaataatttaagcttatcgaagattaaaagtttttttttaaaacatggatttagcgaagaccatataaaaatgggatttatggaatttaatgaagagacttacaaagaatctctttataagtatagagcatatatatctttaactgttcatacaaaaaatattgagaaaatggaagcagcagaaaaaaatattgctgagctttataatcaaggtatattaattagtaatagtggggggccaagatattactttgacaatattaatgatataaagcccgaaatgttagcagattcaattagaaatgcgaaattagcggctttggaatttgcaaaacattcaagttcaaaattggggaaaattaaaaacgcaaatcaaggatattttgaatttcttccaattgatagaagcttgggcgatcaagaacgttatccaaaaaaaatattaagaatcgttacaaccgtttcttattatttggattga

SEQ ID NO: 598 - DNA, 636 bp, Borrelia burgdorferi
ttgaaaaaatatattatcaatttaagtttatgtttattattgctttcatgcaatcttttttcaaaagattctcgatcacgccaaaaatacaattttaaagtacccgctaaatcggtttcaaatcctatcaataaagaaaatatagacactgaaaaaggtactaacactacactttgcataaaagaaaaagatagcagaattataattaaagattgtattaataatcaagagctttttaaagtaaaatctaaaagaagatatgattttaaaaaagccatgcttcttggaattcaaacagctttaaaagttataaatattggcaataataataaaaaattaacttccataaaaaaacataatgatcatattttattagaatttaaagataataagatatatataattcgattatctgaacttaaaaaacatttactaaaaagcaagaaaaaaccactattaggaagtccgataccgggcggcggagatgcagaatttgtagatgatcctgatggcagaatagaagcagaattagaggcagaacaagagcaagagatgttagatagagaagattttggagacgaagaagacgaagaattagaagaagaaatatttggaaaagaaaaacctaacaattga

SEQ ID NO: 599 - DNA, 1065 bp, Borrelia burgdorferi
atgaaaaaagttaaaagtaaatatttggctttgggattactttttggttttataagttgtgatttattcataagatatgaaatgaaagaggaatcccctggcttatttgataagggaaactctattttagagactagcgaggaatctattaaaaagcctatgaataagaaaggtaaaggtaagattgctagaaagaaaggcaaaagcaaggtttctagaaaagaaccgtatattcatagtttaaaaagggactctgctaataaaagcaattttttacaaaaaaatgtaattttagaggaagaaagtttaaaaactgaattattaaaagagcaatctgagactagaaaagaaaaaatacaaaaacaacaagatgaatataaagggatgactcaaggaagtttaaattcccttagcggtgaaagtggtgaattggaggagcctattgaaagtaatgaaattgatcttactatagattctgatttaaggccaaagagttccttacaaggcattgcaggatcaaactctatttcatacactgatgaaatagaggaagaggattatgatcagtattatttagatgaatatgatgaagaggatgaagaggaaataagattaagcaatcgatatcaatcttatctagaaggtgttaaatataatgtagattcagcaattcaaacaattactaagatatataatacttatacattattttcaacaaagctaacccaaatgtattctacacgccttgacaactttgctaaagccaaagctaaagaagaagctgcaaagtttacaaaagaagaccttgaaaaaaatttcaagaccttattaaattatattcaagtaagtgtaaagactgcagcaaattttgtatacataaatgacacgcatgcaaaaaggaaattagagaacattgaagcagaaataaaaactttaattgcaaagatcaaagaacaatctaatttatacgaagcatataaagcaatagtaacgtcaatcttattaatgagggattctcttaaagaagtgcaaggtatcattgacaagaatggcgtttggtactaa

SEQ ID NO: 600 - DNA, 555 bp, Borrelia burgdorferi
atgagtaattttgcatgtgaagctaaacccaaatatgagtatgtaaagcaggtatttcttgataaggattttccagaagatgtagttgattatgtgctacttcgtagttcaaattatgtatatgaaaacctagaaagtagcatgagtatgctagaaaaggaaatgaataaagctagagatgagtttagaagtggaatagggaagttagatgaaagaataggcaagttagatgaaaaggtagaaaaagtaagaagtgagctttctgcagagataaagacagtaagaagtgagcttaagggtgagatagtaaagttagatgaaagaatagaaaaagtaagaagtgagcttaagggtgagatagtaaagttagatgaaagaataggcaagttagatgaaaaaataaatacaaatcataaagagcttatagggttgtttaaggaaataagaagtgagaacaactcgcatataaaaagcttgatatatccattttattggatattaggaatatttattccatcagtagtgggaatgtttttatatttactgcaaaaatag

SEQ ID NO: 601 - DNA, 849 bp, Borrelia burgdorferi
atgaaaaagaacatatatattttgaatatatttttatatataccattattttattcgtgttttttgactccaccaaaatcttcaaaaatcaacagtatcaaaaccgaggttttggattttaagataattgaagagggaaatattataaaatatgataaaaagcccattgaagagcgtaatgaaaatacttgtctttcttttaaagaacccgaattaaatgaaataaaagagggggacgtgcttgaattacttgcaggtggttatgttacatgggcaaaatctggtgacttaagggttttaaaagataaaaataacaatttaattgaagatcttagagaacttaggtactcttatattttttcacccattcgattcaaaactttttttagttataattatagcattaatgacaataactataaaatactcggcaaaaaagcacctatagttaagataatagcatttgaatcaactaaagagtttgaaaaaaaatacgaaataaatagtttaaaactaaattctgaagaatctaatattgattttgaacaaaatagaactggtttagccaaaattaatttaaaagaaacttcaaaagaacctaattacatttattcatataattttggagtttttgacaattctttagcagattattttaagttattttataaaaaaaataactgtaactatatgcctgcatatcttactataaaagataaagaaaccgataaatataaaacctacgaaattatattaaatctaaagctatttaacgataccattaaattattaattaataagtattcaaatttatcaaaagaaaaattaaaactttttactgatgaatga

SEQ ID NO: 602 - DNA, 555 bp, Borrelia burgdorferi
atgaggattttggttggcgtttgtataatagcagcattggctttattgggttgttatttgcctgataatcaggaacaagctgttcaaactttttttgagaattcggaaagtagtgatatgggttccgatgagattgttactgaaggcatattttctagtttaaaattatatgcgtctgaacatcgtttattggttgagataaaaaagactttaattagtttaaaagatcctaattatcgtgatgtagtacgcccagtgagtgactataatgaggagtattttaataaattctttctagatttagggtctgagcaatctaaagacctgattaagttgtttattatggtaaaaaatgagcagaacaataataaatttatgcgtatagttcgttggctgtattcatgtatagaggagttatattctctagatattaagtattctggcgaggggagccatgagtataatcgtaatatgcctagacccactgcttatgaacaatatttaaaagtgaagaggtatgattataatagcccagtttctattttacctacataa

SEQ ID NO: 603 - DNA, 558 bp, Borrelia burgdorferi
atgagtgatataacaaaaattaaacaagaatttgataagaaagttgcagaaattcaagcattaatgaaaaatccccaacaagactcaggattgcttagcaattctattgattttagagaccaaaatctaattttttccaattctggtggggtttgcactagcagtaaagacaaaatagagaattaccctgctaaagggtatccgtataaacggggtgttaagcttagttttggagatggaacaaccgaactagaagttgaggctggtggtggagacgatttatatggagtgtgttccgatatagatgagtttagcggtatggcaactgttataccaattacaaataactttactgggtatttaacgctaaagaaagatggacaaaatggtgtaaatccaggagataaattaaattttaaccaacatggggaacttgaaaaggtcactggggctcaaaaatctgttaatgcaatagcactttcaaaggcacacaaattaactgaagatttatttatagtgcttgctagtgtatttgggaatagagcaataaaagggtaa

SEQ ID NO: 604 - DNA, 585 bp, Borrelia burgdorferi
gtgtataatatgactataagggaaaattttatggaaacagtgtcaacaaatattgcaagtgtaactcaagaacaaatatataaagaatttattagactgggcatggaacaactaatagcacaagatttatctaaaagatattatcacaatgagctaacatatagagatttagaaaatttagaaaaacaatttgatataaaatttgataatcttgtttctaaaatagatggtgtcaaaaatgaacttaacactaaaattgataatgtagaaaaaaatttacaaaaagatatatctaatttagatatcaagatagataatgtagaaaagaatttgcaaaaagacatatctaatttagatactaagattgatagtgttaaaaccgaacttaatactaagattgatactgtagaaaagaatttaaatgccaaaatagatagtgttgaaaagaatttaaatgccaaaatagacaatgttgaaaagaatttaatgtctctttcagaaatgcttaaatgggtattgggaattatgggagcaatgtctataacaatgatagcagggctaatatttgcttttatttccaaatag

SEQ ID NO: 605 - DNA, 1137 bp, Borrelia burgdorferi
atgaataaaaaaacaattattatttgtgcagtttttgcgctgatactttcttgtaagaattatgcaattaaagatttagaacaaaatgcaaaagggaaaattaaaggatttatagataaggctttggatccagcaaaagataaaattacttcaagtagttcaaaagtagatgaattagcaagaaaattacaagaagaagataaaataaagggtgtagaagaaaacaataaagatgaattaatgcagggtgatgatcctaatagtggtgtaataaattcgtcaccagtattgccagaaaatagtcaagataatacaccaatattaaaagcagcggaacaaagtgatggtcaacaagaagagaaagtgaaaaaagtagaagaatccgaagctaaagttgagggaaaagaagaaaaacaagagaatacagaagaacgaaacaaacaagaattagctaaacaagaagaagaacaacaaaaacgaaaagcagaacaagaaaaacaaaaaagagaagaagagcaagaaagacaaaaaagagaagaagagcaagaaagaaaagctaaggcagaaaaagaagctaaagaaaaagcagaaagacaaaaacaagaagaacaacaaaaacgaaaagcagaaaaagaaagagaagaacaacgaaaagaggcagaaaaaaggcaagttgataacgaaattagaacacttacaggcaaaatagatgaaatcaatagaaatattgatgttataaaagagcaaactagtgtgggggcacaaggtgttatagatagaattacagggcctgtatatgatgattttactgatgggaataaagctatatacaaaacttggggggatttggaagatgataacgacgaaggattaggaaagctattaaaagaattgagtgatactagacataatttaagaaccaaattaaatgagggtaataaagcatatattattgatactagaagcactgaaccccaattaaaagaaaatgtaagtgttagcgaaattaaatcagacttagatgaactaaaatcaaaattagaagaagttaaagaatatcttgaagataaagataattttgaagaaattaaagaatacgttgctggtagtgaggataattatgatgaagaagattaa

SEQ ID NO: 606 - DNA, 483 bp, Borrelia burgdorferi
atgagaaataaaaacatatttaaattattttttgcatcaatgttatttgtaatggcttgtaaagcatatgtagaagaaaagaaagaaatagattcattaatggaggatgttttagctcttgtaaatgattcttctggaggcaaatttaaagattataaagacaaaataaatgaattaaaagaaaatttaaaagatataggcaatgcagagcttaaagaaaaactattaaatttgcaaaattcctttcaggataaattagcggccaaattagcagcgttaaaagcagctaaaaataccattgaaaacattactgacaaggatcaggatatttcaaaaagaaaaatatggtcagaagcaaaattagttggagtaactgtaccacttcttggaagcaatacttctggtaatggggataaaatgtctaaaaacgctgtagaacagatagacaaagtaataaagttcctcgaagagggcactaattaa

SEQ ID NO: 607 - DNA, 579 bp, Borrelia burgdorferi
atgaaaaataatacaaaattaataatcaataaaagggatattgattctgaggggaatgcattacttgtagattcttctaatgttagtaaaaatggtgttgaaacagatcgttataatactttgaaaaagaaattgtatgtaaaccttagagaaggagtttctaatagagtagaatgtatgaaaatcttaaaagaaattaaagataatgaatactataaacttgatggatacaaaagtttcgatgcttttataaaggattatgatgttgcaaaaactcaagcgtataactatttaaaaattgccaatgcaatagaagcaggagttattgaggaacaatatgtattagataatggatttagattaatattaagtgtattgaaagataaagaaagtccagtattgaaaaaatctaaacaaaactcaataaaaccattgagatttcaacttaaaactcaagaaagttatgatttttacaaaagcaatgctaaatttacaagttttatgatgcaagagatttttgaaaatcaaaaagatttgattagtaaacttttaaaaatgtataaacaattaaaaggataa

SEQ ID NO: 608 - DNA, 669 bp, Borrelia burgdorferi
atgaacaatttagcatacaaaacatataacatagaaagtataaaaaacgaatttttaaatatagggtttagcaaggaagcaatagattttgtttttctgcataatgataattacaactttgaatttttaaaagagaaaataattgatatagagaagaatttgcaaaaagacatatctaatttagatgccaaaatagacaatgtggaaaagaatttaaatttaaaaatagatggtttgaatatcaaaatagacaatgtagaaaagagcttaaatgccaaaatagatagtttagatactaagatagataatgtagagaagaatttaaatattaaaatagatagtgttaaaaatgaacttaattctaaaatagatagtttagacgccaaaatagacaatgtagaaaagagcttaaatgccaaaatagatagtttagatactaagatagataatgtagaaaaaactttgcaaaaagatatatctagcttgaatactaaaatagatagtgtagaaaaaaccttacaaaaggatatatttaacctagataataaaataaatgttttaaaaaacgaacttactgcaagtaatagaacaatacaagtaattttaataatgggaataacacttgctccaattatttattctatattcaataagtattttttaaattaa

SEQ ID NO: 609 - DNA, 771 bp, Borrelia burgdorferi
atggagcaacttatgaataagaaaatgtttattatttgtgctatttttgcgctgatagtttcttgcaagaattacgcaagtggtgaagatgtaaaaaaaagtttagaacaagatttaaaaggaaaagttaagggatttttagatacaaaaaaagaagagttttttggagattttaaaaaaccagaagcaaaagttcaaccaaaggatgaagaatctatgcaagctgatgagcctcaggagcagggcgaagatcaagtggttcaaggtgttgctgaagatcaaaaattaaaagaagaaattgaacaaaaaataaaagaattaaaggataagatagagaagtcggatcctaaaagtgtttctcttaaaacatattctgattatgaaaaggaaatagaagaattaaaggaaaaactaaaagataaagaaaagtttgaaaaagaattagaaatccttgagaaagctttaaatgaaaaaatagagaaaagaaaaaaagaattagaagagtctcaaaaaaaatttgaagaacttaagggtcaagttgaatctgcaattggaataactgatggagaaagggctaaaaatcaagggaaagttggaatagaagccttgcggcatgctcggggtttgggctttaaaaatatttctagtggtaatagtactagcgatatagctaaagaaataatagtaagctcgcttaaaaagattgaagaagagcttgaagagcttaaaaagttagagaaagaatctaaagattctaataaaaaagaatag

SEQ ID NO: 610 - DNA, 1089 bp, Borrelia burgdorferi
ttgccgcaagatacaattagtgtaagttttattgactctaggattcagactagtaggcccaattattataatccacttttggtttacaaaacagctaaaatcaaagttaacaaagatgctgctagctataaaatattgaatttaaccgttaataattatgaaaaacaaattgaaactttagaaaaagagaatggaaatgaagaagatcagtttggaaaagaaaaaacactgcttaaaactgcaatgtcaaattttttcaattcaagcgaagaatcgttaaaatcagccgatcttttcatttataaggataagcctgaagagctaaaaaattatcttaaagtacatagacacacttttgttgtacttattaacactgagggggatgcgtcagatgatggacttaaaatttacaaagatgactataataaattcaaaatgccttcaactttttttgtattctcgactaaagaacaagaaataaaagaactatttaaagataaaggcaatactgaaaaagaaagaaatattgctgtttacagtaacaataaagacaatttacaccttaaatttataagtcaatatctccatcaagctagtatttttcatgctgtaaatccttatagcatgccgctggctgctacaccacttgttgatgatactgtaattggaaagttgcgaactgcaaaaatcaacttttattcacttcttaatgaaactgggcttgatggtttacctgcctttaaagaaggtgttgacctagctggaagtacaatagacgaacaatttacataccactatataaaaaacgaagcgattattgagcttattaaaatttggaacaaaaacaataggcaaaatagcaaattatctgcactgcagcttagtggagctagagacaatgcatatacttcagcaattgaatgtttactgaaaaggtttgtggatagaggactgattattgagtacaaaaatttaaatcttactctttctcctaccccgcaacttaaattagaacttggcgtgaatattacttataactttagcattaatgctgttgctttagtaattactactcaagatatagtttga

SEQ ID NO: 611 - DNA, 585 bp, Borrelia burgdorferi
gtgtataatatgaccataagggaaaattttatggaaacagtgtcaacaaatattgcaagtgtaactcaagaacaaatatataaagaatttattagactgggcatggaacaattaatagcacaagatttatctaaaagatattatcacaatgagctaacatatagagatttagaaaatttagaaaaacaatttgatataaaatttgataatcttatttctaaaatagatagtgtcaaaagcgaacttaatactaaaatagacaatgtagaaaagaatttaaatctaaaaatagatggtttagatactaagatagatactgtagaaaagaatttaaatctaaaaatagatggtttagatactaagatagatactgtagaaaagaatttaaatgtcaaaatagatagtgttaaaagcgaacttaatgctaagatcgatagtgttaaaaatgaacttactgctaaaatagacaatgtagaaaagaatttaatgtctctttcagaaatgcttaaatgggtattgggaattatgggagcaatgtctatcacaatgatagcagggctaatatttgctttcatttctaaatag

SEQ ID NO: 612 - DNA, 429 bp, Borrelia burgdorferi
atgaaaattatcaacatattattttgtttatttttactaatgctaaacagctgtaattctaatgatactaatactagccaaacaaaaagtagacaaaaacgtgatttaacccaaaaagaagcaacacaagaaaaaccaaaatctaaagaagacctgcttagagaaaagctatctgaagaccaaaaaacacatcttgactggttaaaaaccgctttaactggtgctggagaatttgataaatttttaggatatgacgaagacaaaataaaaggtgcacttaatcatataaagagtgaacttgataagtgtactggggataattctgaacaacaaaaaagcaccttcaaagaggtggttaagggggctcttggtggcggtatagatagttttgcaactagtgcaagtagtacctgccaagctcagcaataa

SEQ ID NO: 613 - DNA, 540 bp, Borrelia burgdorferi
atgagaaatttggtgcacagaacatatgatatagaaagcataaaaaatgaatttttaaacataggatttagtgaagaggcaatagattttgtttttcttcataatgataattacaactatgaggttttaaaagagaaaataattgatgtagaaaagaatttgcaaaaagacatatctagtttagatactaagatagataatgtagaaaagaatttaaatgttaagatagataatgtagagaagaatttaaatattaaaatagatagtgttaaaaatgaacttaattctaaaatagatagtttagatactaagatagataatgtagaaaaaactttgcaaaaagatatatctagcttgaatactaaaatagatagtgtagaaaaaaccttacaaaaggatatatttagcctagataataaaataaatgttttaaaaaacgaacttactgcaagtaatagaacaatacaagtaattttaataatgggaataacgcttgctccaattatttattctatattcaataagcattttttaaattaa

SEQ ID NO: 614 - DNA, 561 bp, Borrelia burgdorferi
atgaataagaaaatgaaaatgtttattgtttgtgctgtttttatacttataggtgcttgcaaaattcatacttcatatgatgagcaaagtagtggtgagataaaccatactttatatgatgagcaaagtaatggtgagttaaaacttaaaaaaatagaattctctaaatttactgtaaaaattaaaaataaagataataatagtaactggacagacctaggagatttagttgtaagaaaagaagaaaatggtattgatacgggtttaaacgctgggggacattcggctacattcttttcattaaaagaatcagaagttaataactttataaaagcaatgactaaaggcggatcatttaaaactagtttgtattatggatataagtacgaacaaagtagtgcaaatggtatccaaaacaaagagatcataacaaaaatagaaagtattaatggtgctgaacatattgcgtttttaggagataaaattaataacggtgtggggggagataaaacagctgaatatgcaataccactagaagtgcttaaaaaaaatttaaaatag

SEQ ID NO: 615 - DNA, 1032 bp, Borrelia burgdorferi
atgaataaaaaaacattgattatttgtgctgtttttgcgctgataatttcttgcaagaattttgcaactggtaaagatataaaacaaaattcagaagggaaaattaaaggatttgtaaataagattttagatccagtaaaggataaaattgcttcaagtggtacaaaagtagatgaagtagcaaaaaaattacaagaagaagaaaaagaagaattaatgcagggcgatgatcctaatggcagtggaataaatccgccaccagtattgccggaaaatattcacaataatgcattagtattaaaagcaatagaacaaagtgatggtcaacaagaaaaaaaagtagaagaagctgaagctaaagttgaagaaaataaagaaaaacaagagaatacagaagaaaacattaaagaaaaagaaataatagacgaacaaaacaaacaagaattagctaaagctaaagaagaagaacaacaaaaagaacaaaaaagacatcaagaagagcaacaaagaaaagctaaagcagaaaaagaaaaaagagaaagagaagaggcagaacaacaaaaacgacaacaagaagaggaagaaaaaaggcaagttgataaccaaattaaaacacttatagctaaaatagatgagatcaatgaaaatattgatgttataaaatggcaaacgactgtaggcccacaaggcgttatagatagaattactgggcctgtgtatgatgattttaccaatggcaataattctatacgcgaaacttgggaggggttagaagaggaatcagaagacgaaggattaggaaaattattgaaagaattgagtgatgctagggacgcgctaagaactaaattaaatgaaggcaataaaccatatactggttacgaagagcctaagttaaaagaaagtgtaaatgttagcgaaattaaagaagatttagaaaaattaaaatcaaaattagaagaagttaaaaaatatcttaaagatagttctaaatttgaagaaattaaaggatacatcagtgacagtcagtaa

SEQ ID NO: 616 - DNA, 573 bp, Borrelia burgdorferi
atgactaatttagcgtacagaacatataacatagaaagcataaaaaatgaatttttaaacatagggtttagtgaggaggcaatagattttgtttttcttcataatgataatttcaattttgaatttttaaaagagaaaataatcgatttagaaaagaatttgagaaaagatatatctaatttagatataaaaatagatactgtagaaaaaagtttaaatctaaaaatagatactatagaaaaaagtttaaatctaaaaatagattttgtagaaaagagtttaaatgccaaaatagatagtttagataccaagataaataatgtagaaaaaactttacaaaaagatatatccagtttagatactaaaatagatagtgtaaaaaacgaacttaattctaaaatagatagtatagaaaaaaccttgcaaaaggatatatctagtctagataataaaatagatgttttaaaaaatgaacttaatgcaagcaatagaacaatacaagtaattctaataatgggaataacacttgctccaattatctattctatatttaataagtatttctttaattga

SEQ ID NO: 617 - DNA, 690 bp, Borrelia burgdorferi
atgaataagaaaatgaaaatgtttattatttgtgctgtttttgcattgatgatttcttgcaagaattatgcaagtggtgaaaatctaaaaaattcagaacaaaatctagaaagttcagaacaaaatgtaaaaaaaacagaacaagagataaaaaaacaagttgaaggatttttagaaattctagagacaaaagatttatctaaattagatgaaaaagatacaaaagaaattgaaaaacaaattcaagaattaaagaataaaatagaaaaattagattctaaaaaaacttctattgaaacatattctgagtatgaagaaaaaataaacaaaataaaagaaaaattgaaaggaaaaggacttgaagataaatttaaggagcttgaagagagtttagcaaagaaaaagggggagagaaaaaaagctttacaagaggccaaacagaaatttgaagaatataaaaaacaagtagatacttcaactgggaaaactcaaggcgacaggtctaaaaaccgaggtggtgttggagtgcaagcttggcagtgtgccaatgaattaggtttgggtgtaagttattctaatggcggcagtgacaacagcaatactgatgaattagcaaacaaagttatagatgattctcttaaaaagattgaagaagaacttaagggaatagaagaagataaaaaagaataa

SEQ ID NO: 618 - DNA, 633 bp, Borrelia burgdorferi
atgactaatttagcgtacaaaacgtataacatagaaagcataaaaaatgagtttttaaacataggatttagtgaagaggcaatagattttgttttgcttcataatgaaaattacagctttgaggttttaaaagaaaaattgattaatgtagagaagaatttgcaaaaagatatatctagtttggacattaagatagatactgtagaaaagaatttacaaaaggatatatctaatttagacattaagattgatgccgtggaaaagaatttacaaaaggatatatctaatttagacatcaagattgataatgtagaaaagaatttgaaaaaagatatatctagtttagatactaagattgatgttgtagagaagaatttaaatctaaaaatagattttgtagaaaagagtttaaatgccaaaatagatagtttagacgttaaaatagataatgtaaataataaagtagattatattaaaagtgaacttattgccaagatagatagtgtagaaaaagggttaaacgaaaaacttaatacaggaaataggctaatacattttatgatattaacagcagcgattctaggcccagttttaaatgccctatttatgagatatttacaatatatcaaataa

SEQ ID NO: 619 - DNA, 1137 bp, Borrelia burgdorferi; identical to SEQ ID NO: 605

SEQ ID NO: 620 - DNA, 552 bp, Borrelia burgdorferi
atgaggattttggttggcgttttcataatagcagcattggctttattgggttgttatttgcctgataatcaggaacaagctgttcaaactttttttgagaattcggaaagtattgatatgggttccgatgagattgttactgaaggcatattttctagtttaaaattatatgcgtctgaacatcgtttattggttgagataaaaaagactttaattagtttaaaagatcctaattatcgtgatgtacccccagtgcgtgactataatgaggagtattttaataaattctttttagatttaggttctgagcaatctaaagacttgattaagttgtttggtagggtaaaaaatgagcagaataataaatttaaaagtgaagtttattggctgtattcatgtataagcgagttatattctccagatattaagtattctggcgaagaggggagccctgagtatgatcgttttatgcctagacccactgcttatcaacaatatttaaaagtgaagagagaaatagaaagaaatacaattaatggaaaaattttatga

SEQ ID NO: 621 - DNA, 865 bp, Borrelia burgdorferi
atgaaaaagaacatatgtattttgaatatatttttatatataccattattttattcatgctttttgactacaccaaaatcttcaaaaatcaacagtatcaaaaccgaggttttggattttaagataattgaagagggaaatattataaaatatgataaaaagcccattgaagagagtaatagcaatatttgtcttacctttaaggaacccgaattaaacgaaataaaagaaggagaggcatttgaaatacttgcaagtggttatgttacatgggcaaaatctggtgatttaaaagatataaaagataaaaataacaatttaattgaaaatcttagagagcttaagtattcttatattttttcacccatccgattcaaaacttattcattgcttacctttagctatacttaattatagcattaatgacaataactataaaatattcggtcaagaagtacctatagctaagataatagcatttgaatcaactgaagagtttgaaaacaaatatgaaatcaaaagtttaaaactaaattctgaagagtcgaatattgattttgaacaaaatagaactggttttgccaaaatcaatttaaaagaaacttcaagggaacctcaatacatttattcatataattttggggtttttgacaattccttagtagattattttaagctcttttacaagaaaagtaaatgcaactatatgcctgcatatcttactataaaagataaacaaacaaataaagataaaacctacgaaatcatattaaatctaaagctatttaataatactattagattaatatttaataagtattcaaatttatcaaaagaaaaattaaaactttttactgatgaatga

SEQ ID NO: 622 - DNA, 717 bp, Borrelia burgdorferi
atgaccataagggaaaattttatggaaacagtgtcaacaaatattgcaagtgtaactcaagaacaaatatataaagaatttattagactgggtatggaacaactaatagcacaagatttatctaaaagatattatcacaatgagctaacatatagagatttagaaaatttagaaaaacaatttgatataaaatttgataatcttatttttaagattgatagcgtagaaaagaatttacaaaaagatatatccaatttagacgttaagattgatactgtagagaagaatttaaatgccaaaatagatggtgtagagaagaatttaaatgccaaaatagatggtgtagagaagaatttaaatgccaaaatagatagtgtggaaaagaatttaaatctaaaaatagatagtttagatactaagatagatactgtagaaaagaatttacaaaaggatatatctaatttagatactaagattgatactgtagagaagaatttaaatgttaagattgatactgttaaaagcgaacttaatactaaaatagacaatgtagaaaagaatttacaaaaagacatatctaatttagatgctaaaatagataatgtagaaaagaatttaatgtctcttacagaaatgcttaaatgggtattaggaatcatgggagcaatgtctatcacaatgatagccgggctaatatttgctttcatttctaaatag

SEQ ID NO: 623 - DNA, 756 bp, Borrelia burgdorferi
atggataataaaaaacctaaaataatcacaatagcgtcaattaagggcggtgttgggaaaagtacaagtgctattataatggcaacattgcttgcaaaagagcataaagttcttttaattgatatggatacacaagcatccactacaagttatttttataaagaaattttaaatcaaaatattgatattgtgaaaattaatgtatatagagtgttaaaagaaaaaatagatattaatgattcaattgtaaagattaaagaaaatttagacttaatccccagttatttaactttaaataaatttttaagcgaatccataccattaaaagagttaaggttgcaaaataatttagaatttttaaagcggaggtatcattatgtaataatagatactaatcctagtttagattacactctgtcaaatgctttaatgactagtaattgcataatagttccaatgactgcggaaaaatgggcggttgaaagtttagaattattggaatttcatatgaacaatttaaaaataaaaattccaatatttttggttataacacgatttaagaaaaacaatactcataagcaattgttacaacacgttgaatctaagacaggatttttgggatttatccatgaacgagaagatttaaataaaaaaattgctaaaaatgaagagtttgatatgaccaaagattatattaatgaatataaaggggtattatcaagatttttaattgtatatgatgaatatgttaaataa

SEQ ID NO: 624 - DNA, 537 bp, Borrelia burgdorferi
atgaatagtttgacttacagaacatacaatatagaaagtataaaaaatgagtttttaaagataggatttagtgaagaggcaatagattttgtttttctgcataatgataattacaactttgaatttttaaaagaaaaattgattaatgtagaaaagaatttacaaaaggatatatctaatttagacattaagattgatactgtagaaaagaatttaaacactaaaatagacaatgtagaaaagaatttaaacactaaaatagacaatgtagaaaagaatttaaatctaaaaatagataatttagactctaaaatagatactgtagaaaagaatttaaacactaaaatagacaatgttgaaaagaatttaaacctaaaaatggatggcttgaatatcaaaatagacaatgtagaaaagagtttaaatcaaaaacttagcatgggtaacagactagtacattttatgataataacagcagcaattctagggccaattttgaatgccctatttatgaaatatttacaaggtggcaaataa

SEQ ID NO: 625 - DNA, 387 bp, Borrelia burgdorferi
atgagtaatttagcctacaatgctcttaaaatagaaaatataaggttagaatttttaaataaggggtttagtgaagaggcaatagattttgttttacttcagaacgacaattacaactttgaagttttaaaggagaaaatgaattctttagaacaacaaataattaatgtagaaaagaattttcaaaaagatatagatagtgtaaatactaaaatagatagtgtagaaaaaactttgcaaaaagatatatctagtctagacaataaaatagatatttaaaaaaatgaacttaatgcaagcaatagaacaatacaagtaattctaataatgggaataacgtttgccccaattatctattctatatttaataagtgttttttcaattga

SEQ ID NO: 626 - DNA, 675 bp, Borrelia burgdorferi
atgaataaaaaaataaaaatgtttattatttgtgctatttttatgctgataagttcttgtaagaatgatgtaactagtaaagatttagaaggggcggtgaaagatttagaaagttcagaacaaaatgtaaaaaaaacagaacaagagataaaaaaacaagttgaaggatttttagaaattttagagacaaaagatttaaacacattagatacaaaagaaattgaaaaacaaattcaagaattaaagaataagatagaaaaattagactctaaaaaaacttctattgaaacatattctgggtatgaagaaaaaataaacaaaataaaagaaaaattaaacggaaaaggacttgaagataaattaaatgaactttcagagagcttaaaaaagaaaaaagaggagagaaaaaaagctttacaagaggctaaaaagaaatttgaagagtataaaaaccaagctgaatctgcaactggagtaacgcatggttctcaagtccaaagacaaggtggtgttggattacaagcttggcagtgtgctaatagtttggggtttaaaaatatgactagtggtaataatactagcgatatgaccaatgaagttataactaattcgcttaaaaagattgaagaagaacttaaaaatattggagaaactgtagaaggtaaaaaagaataa

SEQ ID NO: 627 - DNA, 591 bp, Borrelia burgdorferi
atgaataagaaaatgaaaaatttaattatttgtgcagtttttgttttgataatttcttgcaagattgatgcgagtagtgaagatttaaaacaaaatgtaaaagaaaaagttgaaggatttttagataaagagttaatgcaaggtgacgatcctaataacagtctgtttaatccaccaccagtattgccggcaagttcccacgataacacacccgtattaaaagcggtgcaagcaaaagatggtggtcaacaagaaggaaaagaagagaaagaaaaagaaattcaagaattaaaggataaaatagataaaagaaaaaaagaattagaagaggctagaaagaaatttcaagaatttaaagaacaagttgaatctgcaactggagaaagtactgagaaagttaaaaaacaaggaaatattggacaaaaagctttaaagtatgctaaagaattgggtgtaaatggaagttattctgttaatgatggtactaatactaatgattttgtaaaaaaggttatagatgatgctcttaaaaatattgaggaagaacttgaaaagctagcagagcctcaaaatatagaagataaaaaataa

SEQ ID NO: 628 - DNA, 528 bp, Borrelia burgdorferi
aattctgctgatgagtctgttaaagggcctaatcttacagaaataagtaaaaaaattacggattctaatgcggttttacttgctgtgaaagaggttgaagcgttgctgtcatctatagatgaaattgctgctaaagctattggtaaaaaaatacaccaaaataatggtttggataccgaaaataatcacaatggatcattgttagcgggagcttatgcaatatcaaccctaataaaacaaaaattagatggattgaaaaatgaaggattaaaggaaaaaattgatgcggctaagaaatgttctgaaacatttactaataaattaaaagaaaaacacacagatcttggtaaagaaggtgttactgatgctgatgcaaaagaagccattttaaaaacaaatggtactaaaactaaaggtgctgaagaacttggaaaattatttgaatcagtagaggtcttgtcaaaagcagctaaagagatgcttgctaattcagttaaagagcttacaagccctgttgtggcagaaagt

SEQ ID NO: 629 - DNA, 525 bp, Borrelia burgdorferi
aattctgctgatgagtctgttaaagggcctaatcttacagaaataagtaaaaaaattacagaatctaacgcagttgttctggctgtaaaagaaattgaaactttgctttcatctatagatgaacttgctactaaagctattggtcaaaaaatagatgcaaatggtttaggcgttcaggcgaatcaaaacggatcattgttagcaggtgcctatgcaatatcaaccctaataacacaaaaattaagtgcattaaattcagaagacttaaaagaaaaagttgcaaaggttaagaaatgttccgaagacttcactaacaagttaaaaaatggtaatgcacagcttggcttagctgctgctactgatgataatgcaaaagcggcgattttaaaaacaaatgggactaacgataagggcgctaaagaacttaaagatctatctgattcagtagaaagcttggtaaaagcagctcaagtaatgctaactaattcagttaaagagcttacaagtcctgttgtggcagaaagt

SEQ ID NO: 630 - DNA, 531 bp, Borrelia burgdorferi
aattctgctgatgagtctgttaaagggcctaatcttacagaaataagtaaaaaaattacagaatctaacgcagttgttctggctgtgaaagaaattgaaactttgcttgcatctatagatgaacttgctactaaagctattggtaaaaaaatacaacaaaatggtggtttagctgtcgaagcggggcataatggaacattgttagcaggtgcttatacaatatcaaaactaataacacaaaaattagatggattgaaaaattcagaaaaattaaaggaaaaaattgaaaatgctaagaaatgttctgaagattttactaaaaaactagaaggagaacatgcgcaacttggaattgaaaatgttactgatgagaatgcaaaaaaagctattttaataacagatgcagctaaagataagggcgctgcagagcttgaaaagctatttaaagcagtagaaaacttggcaaaagcagctaaagagatgcttgctaattcagttaaagagcttacaagtcctattgtggcagaaagt

SEQ ID NO: 631 - DNA, 531 bp, Borrelia burgdorferi
aattctgccgatgagtctgttaaagggcctaatcttacagaaataagtaaaaaaattacagaatctaatgcagttgtactggctgtaaaagaagttgcggcgttgctttcatctatagatgagcttgctaaagctattggtaaaaaaataaataataatggtttagatgatgtgcaaaacttcaacgcatcattattggcaggagctcatacaatatcaaaattagtaacagaaaaattaagcaaattgaaaaattcagaaggattaaaagaaaaaattgaggacgccaaaaaatgttctgatgattttactaaaaaactacaatctagccatgcacagcttggtgttgctggtggtgctactactgatgaagaggctaaaaaagctattttaagaacaaacgcaattaaagataagggcgcagatgaacttgaaaagttatttaaatcagtagaaagcttagcaaaagcagctcaagacgcactagccaattcagttaacgagcttacaagtcctgttgtggcagaaact

SEQ ID NO: 632 - DNA, 531 bp, Borrelia burgdorferi
aattctgctgatgagtctgttaaagggcctaatcttacagaaataagtaaaaaaattacggattctaatgcggttttacttgctgtgaaagaggttgaagtgttgctgtcatctatagatgaacttgctaagaaagctattggtaaaaaaatagatcaaaacaatgctttaggcactctaaataatcataacggatcattgttggcgggagcttatgctatatcagctctaataacagaaaaattaagttcaataaaagattcaggagaattgaaggcagaaattgaaaaggctaagaaatgttctgaaagctttactaaaaaactatcagataatcaagcagagcttggtatagagaatgctactgatgataatgcaaaaaaggctattttaaaaacacataatgctaaagacaagggtgctgaagaacttgtaaagttatctgaatcagtagcaggcttattaaaagcagctcaagccatactggctaattcagttaaagagcttacaagtcctgttgtggcagaaagt

SEQ ID NO: 633 - DNA, 534 bp, Borrelia burgdorferi
aattctgctgatgagtctgttaaagggcctaatcttacagaaataagtaaaaaaattacagaatctaacgcagttgttctcgccgtgaaagaagttgaaactctgcttgcatctatagatgaagttgctaagaaagctattgggaatttgatagcccaaaatggtttaaatgccggcgcaaatcaaaacggatcattgttagcgggagcctacgtaatatcaaccctaatagcagaaaaattagatggattgaaaaattcagaagaattaaaggaaaaaattgaagatgctaaaaaatgtaacaaagcatttactgataaactaaaaagtagtcatgcggaactcggtatagcgaatggagctgctactgatgctaatgcaaaagcggctattttaaaaacaaatggtactaaagataagggtgctcaagagcttgaaaagttatttgaatcagtaaaaaacttgtcaaaagcagctcaagaaacactaaataattcagttaaagaacttacaagtcctgttgtggcagaaaat

SEQ ID NO: 634 - DNA, 528 bp, Borrelia burgdorferi
aattctgctgatgagtctgttaaagggcctaatcttacagaaataagtaaaaaaattacagaatctaacgcagttgttctcgccgtgaaagaagttgaaactttgcttacatctatagatgagcttgctaaagctattggtaaaaaaataaaaaacgatgttagtttagataatgaggcagatcacaacggatcattaatatcaggagcatatttaatttcaacattaataacaaaaaaaataagtgcaataaaagattcaggagaattgaaggcagaaattgaaaaggctaagaaatgttctgaagaatttactgctaaattaaaaggtgaacacacagatcttggtaaagaaggcgttactgatgataatgcaaaaaaagccattttaaaaacaaataatgataaaactaagggcgctgatgaacttgaaaagttatttgaatcagtaaaaaacttgtcaaaagcagctaaagagatgcttactaattcagttaaagagcttacaagccctgttgtggcagaaagt

SEQ ID NO: 635 - DNA, 537 bp, Borrelia burgdorferi
aattctgctgatgagtctgttaaagggcctaatcttgcagaaataagtaaaaaaattacagaatctaacgcagttgttctggctgtaaaagaagttgaggctttgcttgcatctatagatgaaattggtagtaaagctattggtaaaagaatacaagcgaatggtttacaggacttgcaagggcagaacggatcattgttagcaggagcctatgcaatttcaaatttaataacacaaaaaataaatgtattaaatggactgaaaaattcagaagaattgaaagagaaaattaacgaggctaagggctgctctgaaaaatttactaaaaaactatcagaaagtcatgcagatattggtatacaagccgctactgatgctaatgcaaaagatgctattttaaaaacaaatcctactaaaactaagggtgctgaagaacttgataagttatttaaagcggtggaaaacttgtcaaaagcggctaaagagatgcttgctaattcagttaaagaacttacaagtcctgttgtggcagaaagt

SEQ ID NO: 636 - DNA, 525 bp, Borrelia burgdorferi
aattctgctgatgagtctgttaaagggcctaatcttacagaaataagtaaaaaaattacagaatctaacgcagttgttctggccgtgaaagaagttgagaccttacttgcatctatagatgaacttgctaccaaagctattggtaaaaaaataggcaataatggtttagaggccaatcagagtaaaaacacatcattgttatcaggagcttatgcaatatctgacctaatagcagaaaaattaaatgtattgaaaaatgaagaattaaaggaaaagattgatacagctaagcaatgttctacagaatttactaataaactaaaaagtgaacatgcagtgcttggtctggacaatcttactgatgataatgcacaaagagctattttaaaaaaacatgcaaataaagataagggtgctgcagaacttgaaaagttatttaaagcggtagaaaacttatcaaaagcagctcaagacacattaaaaaatgctgttaaagagcttacaagtcctattgtggcagaaagt

SEQ ID NO: 637 - DNA, 1017 bp, Borrelia burgdorferi
gctaaaagccaagttgctgataaggacgacccaacaaacaaattttaccaatctgtcatacaattaggtaacggatttcttgatgtattcacatcttttggtgggttagtagcagaggcttttggatttaaatcagatccaaaaaaatctgatgtaaaaacctattttactactgtagctgccaaattggaaaaaacaaaaaccgatcttaatagtttgcctaaggaaaaaagcgatataagtagtacgacggggaaaccagatagtacaggttctgttggaactgccgttgagggggctattaaggaagttagcgagttgttggataagctggtaaaagctgtaaagacagctgagggggcttcaagtggtactgctgcaattggagaagttgtggctgatgctgatgctgcaaaggttgctgataaggcgagtgtgaaggggattgctaaggggataaaggagattgttgaagctgctggggggagtgaaaagctgaaagctgttgctgctgctaaaggggagaataataaaggggcagggaagttgtttgggaaggctggtgctgctgctcatggggacagtgaggctgctagcaaggcggctggtgctgttagtgctgttagtggggagcagatattaagtgcgattgttacggctgctgatgcggctgagcaggatggaaagaagcctgaggaggctaaaaatccgattgctgctgctattggggataaagatgggggtgcggagtttggtcaggatgagatgaagaaggatgatcagattgctgctgctattgctttgagggggatggctaaggatggaaagtttgctgtgaaggatggtgagaaagagaaggctgagggggctattaagggagctgctgagtctgcagttcgcaaagttttaggggctattactgggctaataggagacgccgtgagttccgggctaaggaaagtcggtgattcagtgaaggctgctagtaaagaaacacctcctgccttgaataagtga

SEQ ID NO: 638 - DNA, 717 bp, human herpesvirus 1
atgtcgcagggcgccatgcgtgccgttgttcccattatcccattccttttggttcttgtcggtgtatcgggggttcccaccaacgtctcctccaccacccaaccccaactccagaccaccggtcgtccctcgcatgaagcccccaacatgacccagaccggcaccaccgactctcccaccgccatcagccttaccacgcccgaccacacaccccccatgccaagtattggactggaggaggaggaagaggaggagggggccggggacggcgaacatcttgaggggggagatgggacccgtgacaccctaccccagtccccgggcccagccttcccgttggctgaggacgtcgagaaggacaaacccaaccgtcccgtagtcccatcccccgatcccaacaactcccccgcgcgccccgagaccagtcgcccgaagacaccccccaccattatcgggccgctggcaactcgccccacgacccgactcacctcaaagggacgacccttggttccgacgcctcaacataccccgctgttctcgttcctcactgcctcccccgccctggacaccctcttcgtcgtcagcaccgtcatccacaccttatcgtttttgtgtattggtgcgatggcgacacacctgtgtggcggttggtccagacgcgggcgacgcacacaccctagcgtgcgttacgtgtgcctgccgtccgaacgcgggtag

SEQ ID NO: 639 - DNA, 486 bp, human herpesvirus 1
atgagccagacccaacccccggccccagttgggccgggcgacccagatgtttacttaaaaggcgtgccgtccgccggcatgcaccccagaggtgttcacgcacctcgaggacacccgcgcatgatctccggacccccgcaacggggtgataatgatcaagcggcggggcaatgtggagattcgggtctactacgagtcggtgcggacactacgatctcgaagccatctgaagccgtccgaccgccaacaatccccaggacaccgcgtgttccccgggagccccgggttccgcgaccaccccgagaacctagggaacccagagtaccgcgagctcccagagaccccagggtaccgcgtgaccccagggatccacgacaaccccggtctcccagggagccccggtctccccgggagccccggtctccccgggagccccggaccccacgcaccccccgcgaaccacgtacggctcgcgggtctgtatag

SEQ ID NO: 640 - DNA, 1653 bp, human herpesvirus 1
atggatcgcggggcggtggtggggtttcttctcggtgtttgtgttgtatcgtgcttggcgggaacgcccaaaacgtcctggagacgggtgagtgtcggcgaggacgtttcgttgcttccagctccggggcctacggggcgcggcccgacccagaaactactatgggccgtggaacccctggatgggtgcggccccttacacccgtcgtgggtctcgctgatgccccccaagcaggtgcccgagacggtcgtggatgcggcgtgcatgcgcgctccggtcccgctggcgatggcgtacgcccccccggccccatctgcgaccgggggtctacgaacggacttcgtgtggcaggagcgcgcggccgtggttaaccggagtctggttattcacggggtccgagagacggacagcggcctgtataccctgtccgtgggcgacataaaggacccggctcgccaagtggcctcggtggtcctggtggtgcaaccggccccagttccgaccccacccccgaccccagccgattacgacgaggatgacaatgacgagggcgaggacgaaagtctcgccggcactcccgccagcgggaccccccggctcccgcctccccccgcccccccgaggtcttggcccagcgcccccgaagtctcacatgtgcgtggggtgaccgtgcgtatggagactccggaagctatcctgttttcccccggggagacgttcagcacgaacgtctccatccatgccatcgcccacgacgaccagacctactccatggacgtcgtctggttgaggttcgacgtgccgacctcgtgtgccgagatgcgaatatacgaatcgtgtctgtatcacccgcagctcccagaatgtctgtccccggccgacgcgccgtgcgccgcgagtacgtggacgtctcgcctggccgtccgcagctacgcggggtgttccagaacaaaccccccaccgcgctgttcggccgaggctcacatggagcccgtcccggggctggcgtggcaggcggcctccgtcaatctggagttccgggacgcgtccccacaacactccggcctgtatctgtgtgtggtgtacgtcaacgaccatattcacgcctggggccacattaccatcagcaccgcggcgcagtaccggaacgcggtggtggaacagcccctcccacagcgcggcgcggatttggccgagcccacccacccgcacgtcggggcccctccccacgcgcccccaacccacggcgccctgcggttaggggcggtgatgggggccgccctgctgctgtctgcactggggttgtcggtgtgggcgtgtatgacctgttggcgcaggcgtgcctggcgggcggttaaaagcagggcctcgggtaaggggcccacgtacattcgcgtggccgacagcgagctgtacgcggactggagctcggacagcgagggagaacgcgaccaggtcccgtggctggcccccccggagagacccgactctccctccaccaatggatccggctttgagatcttatcaccaacggctccgtctgtatacccccgtagcgatgggcatcaatctcgccgccagctcacaacctttggatccggaaggcccgatcgccgttactcccaggcctccgattcgtccgtcttctggtaa

SEQ ID NO: 641 - DNA, 1608 bp, human herpesvirus 1
atggagcttagctacgccaccaccatgcactaccgggacgttgtgttttacgtcacaacggaccgaaaccgggcctactttgtgtgcggggggtgtgtttattccgtggggcggccgtgtgcctcgcagcccggggagattgccaagtttggtctggtcgttcgagggacaggcccagacgaccgcgtggtcgccaactatgtacgaagcgagctccgacaacgcggcctgcaggacgtgcgtcccattggggaggacgaggtgtttctggacagcgtgtgtcttctaaacccgaacgtgagctccgagctggatgtgattaacacgaacgacgtggaagtgctggacgaatgtctggccgagtactgcacctcgctgcgaaccagcccgggtgtgctaatatccgggctgcgcgtgcgggcgcaggacagaatcatcgagttgtttgaacacccaacgatagtcaacgtttcctcgcactttgtgtataccccgtccccatacgtgttcgccctggcccaggcgcacctcccccggctcccgagctcgctggaggccctggtgagcggcctgtttgacggcatccccgccccacgccagccacttgacgcccacaacccgcgcacggatgtggttatcacgggccgccgcgccccacgacccatcgccgggtcgggggcggggtcggggggcgcgggcgccaagcgggccaccgtcagcgagttcgtgcaagtcaaacacattgaccgcgtgggccccgctggcgtttcgccggcgcctccgccaaacaacaccgactcgagttccctggtgcccggggcccaggattccgccccgcccggccccacgctaagggagctgtggtgggtgttttatgccgcagaccgggcgctggaggagccccgcgccgactctggcctcacccgcgaggaggtacgtgccgtacgtgggttccgggagcaggcgtggaaactgtttggctccgcgggggccccgcgggcgtttatcggggccgcgttgggcctgagccccctccaaaagctagccgtttactactatatcatccaccgagagaggcgcctgtcccccttccccgcgctagtccggctcgtaggccggtacacacagcgccacggcctgtacgtccctcggcccgacgacccagtcttggccgatgccatcaacgggctgtttcgcgacgcgctggcggccggaaccacagccgagcagctcctcatgttcgaccttctccccccaaaggacgtgccggtgggaagcgacgtgcaggccgacagcaccgctctgctgcgctttatagaatcgcaacgtctcgccgtccccgggggggtgatctcccccgagcacgtcgcgtaccttggtgcgttcctgagcgtgctgtacgctggccgcgggcgcatgtccgcagccacgcacaccgcgcggctgacaggggtgacctccctggtgctagcggtgggtgacgtggaccgtctttccgcgtttgaccgcggagcggcgggcgcggccagccgcacgcgggccgccgggtacctggatgtgcttcttaccgttcgtctcgctcgctcccaacacggacagtctgtgtaa

SEQ ID NO: 642 - DNA, 1467 bp, human herpesvirus 1
atgacggattcccctggcggtgtggcccccgcctcccccgtggaggacgcgtcggacgcgtccctcgggcagccggaggagggggcgccctgccaggtggtcctgcagggcgccgaacttaatggaatcctacaggcgtttgccccgctgcgcacgagccttctggactcgcttctggttatgggcgaccggggcatccttatccataacacgatctttggggagcaggtgttcctgcccctggaacactcgcaattcagtcggtatcgctggcgcggacccacggcggcgttcctgtctctcgtggaccagaagcgctccctcctgagcgtgtttcgcgccaaccagtacccggacctacgtcgggtggagttggcgatcacgggccaggccccgtttcgcacgctggttcagcgcatatggacgacgacgtccgacggcgaggccgttgagctagccagcgagacgctgatgaagcgcgaactgacgagctttgtggtgctggttccccagggaacccccgacgttcagttgcgcctgacgaggccgcagctcaccaaggtccttaacgcgaccggggccgatagtgccacgcccaccacgttcgagctcggggttaacggcaaattttccgtgttcaccacgagtacctgcgtcacctttgctgcccgcgaggagggcgtgtcgtccagcaccagcacccaggtccagatcctgtccaacgcgctcaccaaggcgggccaggcggccgccaacgccaagacggtgtacggggaaaatacccatcgcaccttctctgtggtcgtcgacgattgcagcatgcgggcggtgctccggcgactgcaggtcggcgggggcaccctcaagttcttcctcacgacccccgtccccagtctgtgcgtcaccgccaccggtcccaacgcggtatcggcggtatttctcctgaaaccccagaagatttgcctggactggctgggtcatagccaggggtctccttcagccgggagctcggcctcccgggcctctgggagcgagccaacagacagccaggactccgcgtcggacgcggtcagccacggcgatccggaagacctcgatggcgctgcccgggcgggagaggcgggggccttgcatgcctgtccgatgccgtcgtcgaccacgcgggtcactcccacgaccaagcgggggcgctcggggggcgaggatgcgcgcgcggacacggccctaaagaaacctaagacggggtcgcccaccgcacccccgcccgcagatccagtccccctggacacggaggacgactccgatgcggcggacgggacggcggcccgtcccgccgctccagacgcccggagcggaagccgttacgcgtgttactttcgcgacctcccgaccggagaagcaagccccggcgccttctccgccttccgggggggcccccaaaccccgtatggttttggattcccctga

SEQ ID NO: 643 - DNA, 1185 bp, human herpesvirus 1
atggggggggctgccgccaggttgggggccgtgattttgtttgtcgtcatagtgggcctccatggggtccgcagcaaatatgccttggtggatgcctctctcaagatggccgaccccaatcgctttcgcggcaaagaccttccggtcctggaccagctgaccgaccctccgggggtccggcgcgtgtaccacatccaggcgggcctaccggacccgttccagccccccagcctcccgatcacggtttactacgccgtgttggagcgcgcctgccgcagcgtgctcctaaacgcaccgtcggaggccccccagattgtccgcggggcctccgaagacgtccggaaacaaccctacaacctgaccatcgcttggtttcggatgggaggcaactgtgctatccccatcacggtcatggagtacaccgaatgctcctacaacaagtctctgggggcctgtcccatccgaacgcagccccgctggaactactatgacagcttcagcgccgtcagcgaggataacctggggttcctgatgcacgcccccgcgtttgagaccgccggcacgtacctgcggctcgtgaagataaacgactggacggagattacacagtttatcctggagcaccgagccaagggctcctgtaagtacgccctcccgctgcgcatccccccgtcagcctgcctctccccccaggcctaccagcagggggtgacggtggacagcatcgggatgctgccccgcttcatccccgagaaccagcgcaccgtcgccgtatacagcttgaagatcgccgggtggcacgggcccaaggccccatacacgagcaccctgctgcccccggagctgtccgagacccccaacgccacgcagccagaactcgccccggaagaccccgaggattcggccctcttggaggaccccgtggggacggtggcgccgcaaatcccaccaaactggcacataccgtcgatccaggacgccgcgacgccttaccatcccccggccaccccgaacaacatgggcctgatcgccggcgcggtgggcggcagtctcctggcagccctggtcatttgcggaattgtgtactggatgcgccgccacactcaaaaagccccaaagcgcatacgcctcccccacatccgggaagacgaccagccgtcctcgcaccagcccttgttttactag

SEQ ID NO: 644 - DNA, 1908 bp, human herpesvirus 1
atggcagccgatgccccgggagaccggatggaggagcccctgcccgacagggccgtgcccatttacgtggctgggtttttggccctgtatgacagcggggactcgggcgagttggcattggatccggatacggtgcgggcggccctgcctccggataacccactcccgattaacgtggaccaccgcgctggctgcgaggtggggcgggtgctggccgtggtcgacgacccccgcgggccgttttttgtggggctgatcgcctgcgtgcagctggagcgcgtcctcgagacggccgccagcgctgcgattttcgagcgccgcgggccgccgctctcccgggaggagcgcctgttgtacctgatcaccaactacctgccctcggtctccctggccacaaaacgcctggggggcgaggcgcaccccgatcgcacgctgttcgcgcacgtcgcgctgtgcgcgatcgggcggcgcctcggcactatcgtcacctacgacaccggtctcgacgccgccatcgcgccctttcgccacctgtcgccggcgtctcgcgagggggcgcggcgactggccgccgaggccgagctcgcgctgtccgggcgcacctgggcgcccggcgtggaggcgctgacccacacgctgctttccaccgccgttaacaacatgatgctgcgggaccgctggagcctggtggccgagcggcggcggcaggccgggatcgccggacacacctacctccaggcgagcgaaaaattcaaaatgtggggggcggagcctgtttccgcgccggcgcgcgggtataagaacggggccccggagtccacggacataccgcccggctcgatcgctgccgcgccgcagggtgaccggtgcccaatcgtccgtcagcgcggggtcgccttgtccccggtactgccccccatgaaccccgttccgacatcgggcaccccggcccccgcgccgcccggcgacgggagctacctgtggatcccggcctcccattacaaccagctcgtcgccggccatgccgcgccccaaccccagccgcattccgcgtttggtttcccggctgcggcggggtccgtggcctatgggcctcacggtgcgggtctttcccagcattaccctccccacgtcgcccatcagtatcccggggtgctgttctcgggacccagcccactcgaggcgcagatagccgcgttggtgggggccatagccgcggaccgccaggcgggcggtcagccggccgcgggagaccctggggtccgggggtcgggaaagcgtcgccggtacgaggcggggccgtcggagtcctactgcgaccaggacgaaccggacgcggactacccgtactaccccggggaggctcgaggcgcgccgcgcggggtcgactcccggcgcgcggcccgccattctcccgggaccaacgagaccatcacggcgctgatgggggcggtgacgtctctgcagcaggaactggcgcacatgcgggctcggaccagcgccccctatggaatgtacacgccggtggcgcactatcgccctcaggtgggggagccggaaccaacaacgacccacccggccctttgtcccccggaggccgtgtatcgccccccaccacacagcgccccctacggtcctccccagggtccggcgtcccatgcccccactcccccgtatgccccagctgcctgcccgccaggcccgccaccgcccccatgtccttccacccagacgcgcgcccctctaccgacggagcccgcgttcccccccgccgccaccggatcccaaccggaggcatccaacgcggaggccggggcccttgtcaacgccagcagcgcagcacacgtggacgttgacacggcccgcgccgccgatttgttcgtctctcagatgatgggggcccgctga

SEQ ID NO: 645 - DNA, 1743 bp, human herpesvirus 1
atggacccgtactgcccatttgacgctctggacgtctgggaacacaggcgcttcatagtcgccgattcccgaaacttcatcacccccgagttcccccgggacttttggatgtcgcccgtctttaacctcccccgggagacggcggcggagcaggtggtcgtcctacaggcccagcgcacagcggctgccgctgccctggagaacgccgccatgcaggcggccgagctccccgtcgatatcgagcgccggttacgcccgatcgaacggaacgtgcacgagatcgcaggcgccctggaggcgctggagacggcggcggccgccgccgaagaggcggatgccgcgcgcggggatgagccggcgggtgggggcgacgggggggcgcccccgggtctggccgtcgcggagatggaggtccagatcgtgcgcaacgacccgccgctacgatacgacaccaacctccccgtggatctgctacacatggtgtacgcgggccgcggggcgaccggctcgtcgggggtggtgttcgggacctggtaccgcactatccaggaccgcaccatcacggactttcccctgaccacccgcagtgccgactttcgggacggccgtatgtccaagaccttcatgacggcgctggtactgtccctgcaggcgtgcggccggctgtatgtgggccagcgccactattccgccttcgagtgcgccgtgttgtgtctctacctgctgtaccgaaacacgcacggggccgccgacgatagcgaccgcgctccggtcacgttcggggatctgctgggccggctgccccgctacctggcgtgcctggccgcggtgatcgggaccgagggcggccggccacagtaccgctaccgcgacgacaagctccccaagacgcagttcgcggccggcgggggccgctacgaacacggagcgctggcgtcgcacatcgtgatcgccacgctgatgcaccacggggtgctcccggcggccccgggggacgtcccccgggacgcgagtacccacgttaaccccgacggcgtggcgcaccacgacgacataaaccgcgccgccgccgcgttcctcagccggggccacaacctattcctgtgggaggaccagactctgctgcgggcaaccgcgaacaccataacggccctgggcgttatccagcggctcctcgcgaacggcaacgtgtacgcggaccgcctcaacaaccgcctgcagctgggcatgctgatccccggagccgtcccttcggaggccatcgcccgtggggcctccgggtccgactcgggggccatcaagagcggagacaacaatctggaggcgctatgtgccaattacgtgcttccgctgtaccgggccgacccggcggtcgagctgacccagctgtttcccggcctggccgccctgtgtcttgacgcccaggcggggcggccggtcgggtcgacgcggcgggtggtggatatgtcatcgggggcccgccaggcggcgctggtgcgcctcaccgccctggaactcatcaaccgcacccgcacaaaccccacccctgtgggggaggttatccacgcccacgacgccctggcgatccaatacgaacaggggcttggcctgctggcgcagcaggcacgcattggcttgggctccaacaccaagcgtttctccgcgttcaacgttagcagcgactacgacatgttgtactttttatgtctggggttcattccacagtacctgtcggcggtttag

SEQ ID NO: 646 - DNA, 735 bp, human herpesvirus 1
atggcttctcttctcggggctatatgtggctggggagcgcgccccgaggaacaatatgagatgatccgcgcggccgttccgccctcggaggcggagccgcggctgcaggaggccctggcggtcgttaacgcgctacttcccgcccccatcacgctcgatgacgccctggggtccctggacgacacccgacgcctcgtgaaggcccgcgccttggcccgcacgtaccacgcctgcatggtgaacctagaacgactggcgcgccaccaccccgggttcgaggcccccacgatcgacggggccgtggcggcccatcaggacaagatgcggcgcctggcggacacgtgtatggccaccatcctgcagatgtacatgtccgtgggggcggctgacaagtccgcggatgtgctcgtctcccaggctattcggagcatggccgagagtgacgtggtcatggaggatgtggccatcgccgaacgggcccttggcctctccgccttcggggttgccgggggaacccggtcgggggggattggggtgaccgaggcgccctccttggggcacccccacacgccgcccccggaggttacgctggcgcctgccgcccgaaacggcgacgccctcccggaccccaaaccggaatcgtgtccccgcgtgtccgttcccagacctacagcctccccaaccgcacctcgccctggcccatctcgagcagctccgtgtgttttgggtcaataa

SEQ ID NO: 647 - DNA, 1473 bp, human herpesvirus 1
atggacctcttggtcgacgagctgtttgccgacatgaacgcggacggcgcttcgccaccgcccccccgcccggccgggggtcccaaaaacaccccggcggcccccccgctgtacgcaacggggcgcctgagccaggcccagctcatgccctccccacccatgcccgtcccccccgccgccctctttaaccgtctcctcgacgacttgggctttagcgcgggccccgcgctatgtaccatgctcgatacctggaacgaggatctgttttcggcgctaccgaccaacgccgacctgtaccgggagtgtaaattcctatcaacgctgcccagcgatgtggtggaatggggggacgcgtacgtccccgaacgcacccaaatcgacattcgcgcccacggcgacgtggccttccctacgcttccggccacccgcgacggcctcgggctctactacgaagcgctctctcgtttcttccacgccgagctacgggcgcgggaggagagctatcgaaccgtgttggccaacttctgctcggccctgtaccggtacctgcgcgccagcgtccggcagctgcaccgccaggcgcacatgcgcggacgcgatcgcgacctgggagaaatgctgcgcgccacgatcgcggacaggtactaccgagagaccgctcgtctggcgcgtgttttgtttttgcatttgtatctatttttgacccgcgagatcctatgggccgcgtacgccgagcagatgatgcggcccgacctgtttgactgcctctgttgcgacctggagagctggcgtcagttggcgggtctgttccagcccttcatgttcgtcaacggagcgctcaccgtccggggagtgccaatcgaggcccgccggctgcgggagctaaaccacattcgcgagcaccttaacctcccgctggtgcgcagcgcggctacggaggagccaggggcgccgttgacgacccctcccaccctgcatggcaaccaggcccgcgcctctgggtactttatggtgttgattcgggcgaagttggactcgtattccagcttcacgacctcgccctccgaggcggtcatgcgggaacacgcgtacagccgcgcgcgtacgaaaaacaattacgggtctaccatcgagggcctgctcgatctcccggacgacgacgcccccgaagaggcggggctggcggctccgcgcctgtcctttctccccgcgggacacacgcgcagactgtcgacggcccccccgaccgatgtcagcctgggggacgagctccacttagacggcgaggacgtggcgatggcgcatgccgacgcgctagacgatttcgatctggacatgttgggggacggggattccccggggccgggatttaccccccacgactccgccccctacggcgctctggatatggccgacttcgagtttgagcagatgtttaccgatgcccttggaattgacgagtacggtgggtag

SEQ ID NO: 648 - DNA, 891 bp, human herpesvirus 1
atggccgccgcgacggccgacgatgaggggtcggccgccaccatcctcaagcaggccatcgccggggaccgcagcctggtcgaggcggccgaggcgattagccagcagacgctgctccgcctggcctgcgaggtgcgccaggtcggcgaccgccagccgcggtttaccgccaccagcatcgcgcgcgtcgacgtcgcgcctgggtgccggttgcggttcgttctggacgggagtcccgaggacgcctatgtgacgtcggaggattactttaagcgctgctgcggccagtccagttatcgcggcttcgcggtggcggtcctgacggccaacgaggaccacgtgcacagcctggccgtgccccccctcgttctgctgcaccggttctccctgttcaaccccagggacctcctggactttgagcttgcctgtctgctgatgtacctggagaactgcccccgaagccacgccaccccgtcgacctttgccaaggttctggcgtggctcggggtcgcgggtcgccgcacgtccccattcgaacgcgttcgctgccttttcctccgcagttgccactgggtcctaaacacactcatgttcatggtgtacgtaaaaccgttcgacgacgagttcgtcctgccccactggtacatggcccggtacctgctggccaacaacccgccccccgttctctcggccctgttctgtgccaccccgacgagctcctcattccggctgccggggccgcccccccgctccgactgcgtggcctataaccccgccgggatcatggggagctgctgggcgtcggaggaggtgcgcgcgcctctggtctattggtggctttcggagaccccaaaacgacagacgtcgtcgctgttttatcagttttgttga

SEQ ID NO: 649 - DNA, 990 bp, human herpesvirus 1
atgaaccccgttccgacatcgggcaccccggcccccgcgccgcccggcgacgggagctacctgtggatcccggcctcccattacaaccagctcgtcgccggccatgccgcgccccaaccccagccgcattccgcgtttggtttcccggctgcggcggggtccgtggcctatgggcctcacggtgcgggtctttcccagcattaccctccccacgtcgcccatcagtatcccggggtgctgttctcgggacccagcccactcgaggcgcagatagccgcgttggtgggggccatagccgcggaccgccaggcgggcggtcagccggccgcgggagaccctggggtccgggggtcgggaaagcgtcgccggtacgaggcggggccgtcggagtcctactgcgaccaggacgaaccggacgcggactacccgtactaccccggggaggctcgaggcgcgccgcgcggggtcgactcccggcgcgcggcccgccattctcccgggaccaacgagaccatcacggcgctgatgggggcggtgacgtctctgcagcaggaactggcgcacatgcgggctcggaccagcgccccctatggaatgtacacgccggtggcgcactatcgccctcaggtgggggagccggaaccaacaacgacccacccggccctttgtcccccggaggccgtgtatcgccccccaccacacagcgccccctacggtcctccccagggtccggcgtcccatgcccccactcccccgtatgccccagctgcctgcccgccaggcccgccaccgcccccatgtccttccacccagacgcgcgcccctctaccgacggagcccgcgttcccccccgccgccaccggatcccaaccggaggcatccaacgcggaggccggggcccttgtcaacgccagcagcgcagcacacgtggacgttgacacggcccgcgccgccgatttgttcgtctctcagatgatgggggcccgctga

SEQ ID NO: 650 - DNA, 3372 bp, human herpesvirus 1
atggcagaccgcggtctcccgtccgaggcccccgtcgtcacgacctcacccgccggtccgccctcggacggacctatgcagcgcctattggcgagcctagccggccttcgccaaccgccaacccccacggccgagacggcaaacggggcggacgacccggcgtttctggccacggccaagctgcgcgccgccatggcggcgtttctgttgtcgggaacggccatcgccccggcagacgcgcgggactgctggcggccgctgctggaacacctgtgcgcgctccaccgggcccacgggcttccggagacggcgctcttggccgagaacctccccgggttgctcgtacaccgcttggtggtggctctccccgaggcccccgaccaggccttccgggagatggaggtcatcaaggacaccatcctcgcggtcaccggctccgacacgtcccatgcgctggattccgccggcctgcgcaccgcggcggccctggggccggtccgcgtccgccagtgcgccgtggagtggatagaccgctggcaaaccgtcaccaagagctgcttggccatgagcccgcggacctccatcgaggcccttggggagacgtcgctcaagatggcgccggtcccgttggggcagcccagcgcgaaccttaccaccccggcgtacagcctgctcttccccgccccgttcgtgcaagagggcctccggttcttggccctggtgagtaatcgggtgacgctgttctcggcgcacctccagcgcatagacgacgcgaccctcactcccctcacacgggccctctttacgttggccctggtggacgagtacctgacgacccccgagcggggggctgtggtcccgccgcccctgttggcgcagtttcagcacaccgtgcgggagatcgacccggccataatgattccgccgctcgaggccaacaagatggttcgcagccgcgaggaggtgcgcgtgtcgacggccctcagccgcgtcagcccgcgctcggcctgtgcgcccccggggacgctaatggcgcgcgtgcggacggacgtggccgtgtttgatcccgacgtgccgttcctgagttcgtcggcactggcagtcttccagcctgccgtctccagcctgctgcagctcggggagcagccctccgccggcgcccagcagcggctgctggctctgctgcagcagacgtggacgttgatccagaataccaattcgccctccgtggtgatcaacaccctgatcgacgctgggttcacgccctcgcactgcacgcactacctttcggccctggaggggtttctggcggcgggcgtccccgcgcggacgcccaccggccacggactcggcgaagtccagcagctctttgggtgcattgccctcgcggggtcgaacgtgtttgggttggcgcgggaatacgggtactatgccaactacgtaaaaactttcaggcgggtccagggcgccagcgagcacacgcacgggcggctctgcgaggcggtcggcctgtcggggggcgttctaagccagacgctggcgcgtatcatgggtccggccgtgccgacggaacatctggcgagcctgcggcgggcgctcgtgggggagtttgagacggccgagcgccgctttagttccggtcaacccagccttctccgcgagacggcgctcatctggatcgacgtgtatggtcagacccactgggacatcacccccaccaccccggccacgccgctgtccgcgcttctccccgtcgggcagcccagccacgccccctctgtccacctggccgcggcgacccagatccgcttccccgccctcgagggcattcaccccaacgtcctcgccgacccgggcttcgtcccctacgttctggccctggtggtcggggacgcgctgagggccacgtgtagcgcggcctaccttccccgcccggtcgagttcgccctgcgtgtgttggcctgggcccgggactttgggctgggctatctccccacggttgagggccatcgcaccaaactgggcgcgctgatcaccctcctcgaaccggccgcccggggcggcctcggccccactatgcagatggccgacaacatagagcagctgctccgggagctgtacgtgatctccaggggtgccgtcgagcagctgcggcccctggtccagctgcagccccccccgccccccgaggtgggcaccagcctcctgttgattagcatgtacgccctggccgcccggggggtgctgcaggacctcgccgagcgcgcagaccccctgattcgccaactggaggacgccatcgtgctgctgcggctgcacatgcgcacgctctccgcctttttcgagtgtcggttcgagagcgacgggcgccgcctgtatgcggtggtcggggacacgcccgaccgcctggggccctggccccccgaggccatgggggacgcggtgagtcagtactgcagcatgtatcacgacgccaagcgcgcgctggtcgcgtccctcgcgagcctgcgttccgtcatcaccgaaaccacggcgcacctgggggtgtgcgacgagctggcggcccaggtgtcgcacgaggacaacgtgctggccgtggtccggcgcgaaattcacgggtttctgtccgtcgtgtccggcattcacgcccgggcgtcgaagctgctgtcgggagaccaggtccccgggttttgcttcatgggtcagtttctagcgcgctggcggcgtctgtcggcctgctatcaagccgcgcgcgcggccgcgggacccgagcccgtggccgagtttgtccaggaactccacgacacgtggaagggcctgcagacggagcgcgccgtggtcgtggcgcccttggtcagctcggccgaccagcgcgccgcggccatccgagaggtaatggcgcatgcgcccgaggacgcccccccgcaaagccccgcggccgaccgcgtcgtgcttacgagccgtcgcgacctaggggcctggggggactacagcctcggccccctgggccagacgaccgcggttccggactccgtggatctgtctcgccaggggctggccgttacgctgagtatggattggttactgatgaacgagctcctgcgggtcaccgacggcgtgtttcgcgcttccgcgtttcgtccgttagccggaccggagtctcccagggacctggaggtccgcgacgccggaaacagtctccccgcgcctatgcccatggacgcacagaagccggaggcctatgggcacggcccacgccaggcggaccgcgagggggcgcctcattccaacacccccgtcgaggacgacgagatgatcccggaggacaccgtcgcgccacccacggacttgccgttaactagttaccaataa

SEQ ID NO: 651 - DNA, 705 bp, human herpesvirus 1
atggcttcggaggcggcgcaacccgacgcgggtttatggagcgcggggaacgcgtttgctgatcccccgcccccctacgatagcttgtctggtaggaacgaggggccgtttgtcgttattgatctggacacccccacggacccacctccaccgtactctgctgggcccctgttgtccgtgccaattccgccaacctcctccggagagggcgaggcgtcggagcggggccgctcacgccaagccgcccagcgagccgctcggcgcgcccggcgccgcgccgaacgacgtgcgcagcgccggagttttggccctggcgggttattggcaacccccctgtttcttccggaaaccaggcttgtggccccacccgacatcacaagggacctcttgtcgggcctcccgacgtacgccgaggctatgtcggaccaccccccaacctatgccactgtcgtggccgttcgttcgaccgaacagccgtccggggctttggcgcccgacgaccagcgacgaacgcaaaactcgggcgcgtggcggcctcctagggtcaattcgcgcgagctgtacagggcccaacgcgcggcgcgcggctcgtctgatcatgccccataccggcgacagggctgttgtggcgtggtgtggcgccatgctgtatttggggtggtcgcgattgtggtggtcattattctggtattcctgtggcggtaa

SEQ ID NO: 652 - DNA, 828 bp, human herpesvirus 1
atggcgggactgggcaagccctacaccggccacccaggtgacgccttcgagggtctcgttcagcgaattcggcttatcgtcccatctacgttgcggggcggggacggggaggcgggcccctactctccctccagcctcccctccaggtgcgcctttcagtttcatggccatgacgggtccgacgagtcgtttcccatcgagtatgtactgcggcttatgaacgactgggccgaggtcccgtgcaacccttacctgcgcatacagaacaccggcgtgtcggtgctgtttcaggggttttttcatcgcccacacaacgcccccgggggcgcgattacgccagagcggaccaatgtgatcctgggctccaccgagacgacggggctgtccctcggcgacctggacaccatcaaggggcggctcggcctggatgcccggccgatgatggccagcatgtggatcagctgctttgtgcgcatgccccgcgtgcagctcgcgtttcggttcatgggccccgaagatgccggacggacgagacggatcctgtgccgcgccgccgagcaggctattacccgtcgccgccgaacccggcggtcccgggaggcgtacggggccgaggccgggctgggggtggccggaacgggtttccgggccaggggggacggttttggcccgctccccttgttaacccaagggccctcccgcccgtggcaccaggccctgcggggtcttaagcacctacggattggcccccccgcgctcgttttggcggcgggactcgtcctgggggccgctatttggtgggtggttggtgctggcgcgcgcctataa

SEQ ID NO: 653 - DNA, 1173 bp, human herpesvirus 1
atgccgtgccgcccgttgcagggcctggtgctcgtgggcctctgggtctgtgccaccagcctggttgtccgtggccccacggtcagtctggtatcaaactcatttgtggacgccggggccttggggcccgacggcgtagtggaggaagacctgcttattctcggggagcttcgctttgtgggggaccaggtcccccacaccacctactacgatgggggcgtagagctgtggcactaccccatgggacacaaatgcccacgggtcgtgcatgtcgtcacggtgaccgcgtgcccacgtcgccccgccgtggcattcgccctgtgtcgcgcgaccgacagcactcacagccccgcatatcccaccctggagctcaatctggcccaacagccgcttttgcgggtccagagggcaacgcgggactatgccggggtgtacgtgttacgcgtatgggtcggtgacgcgccaaacgccagcctgtttgtcctggggatggccatagccgccgaagggactctggcgtacaacggctcggcctatggctcctgcgacccgaaactgcttccgtcttcggccccgcgtctggccccggcgagcgtataccaacccgcccctaaccaggcctccaccccctcgaccaccacctccaccccctcgaccaccatccccgctccctcgaccaccatccccgctccccaagcatcgaccacgcccttccccacgggagatccaaaaccacaacctcccggggtcaaccacgaacccccatctaatgccacgcgagcgacccgcgactcgcgatacgcgctaacggtgacccagataatccagatagccatccccgcgtccatcatagccctggtgtttctggggagctgtatttgctttatacacagatgtcaacgccgctaccgacgctcccgtcgcccgatttacagcccccagatgcccacgggcatctcatgcgcggtgaacgaagcggccatggcccgcctcggagccgagctcaaatcgcatccgagcaccccccccaaatcccggcgccggtcgtcacgcacgccaatgccctccctgacggccatcgccgaagagtcggagcccgctggggcggctgggcttccgacgccccccgtggaccccacgacacccaccccaacgcctcccctgttggtatag

SEQ ID NO: 654 - DNA, 273 bp, human herpesvirus 1
atgacgtcccggctctccgatcccaactcctcagcgcgatccgacatgtccgtgccgctttatcccacggcctcgccagtttcggtcgaagcctactactcggaaagcgaagacgaggcggccaacgacttcctcgtacgcatgggccgccaacagtcggtattaaggcgtcgacgcagacgcacccgctgcgtcggcatggtgatcgcctgtctcctcgtggccgttctgtcgggcggatttggggcgctcctgatgtggctgctccgctaa

SEQ ID NO: 655 - DNA, 1182 bp, human herpesvirus 2
atggggcgtttgacctccggcgtcgggacggcggccctgctagttgtcgcggtgggactccgcgtcgtctgcgccaaatacgccttagcagacccctcgcttaagatggccgatcccaatcgatttcgcgggaagaaccttccggttttggaccagctgaccgacccccccggggtgaagcgtgtttaccacattcagccgagcctggaggacccgttccagccccccagcatcccgatcactgtgtactacgcagtgctggaacgtgcctgccgcagcgtgctcctacatgccccatcggaggccccccagatcgtgcgcggggcttcggacgaggcccgaaagcacacgtacaacctgaccatcgcctggtatcgcatgggagacaattgcgctatccccatcacggttatggaatacaccgagtgcccctacaacaagtcgttgggggtctgccccatccgaacgcagccccgctggagctactatgacagctttagcgccgtcagcgaggataacctgggattcctgatgcacgcccccgccttcgagaccgcgggtacgtacctgcggctagtgaagataaacgactggacggagatcacacaatttatcctggagcaccgggcccgcgcctcctgcaagtacgctctccccctgcgcatccccccggcagcgtgcctcacctcgaaggcctaccaacagggcgtgacggtcgacagcatcgggatgctaccccgctttatccccgaaaaccagcgcaccgtcgccctatacagcttaaaaatcgccgggtggcacggccccaagcccccgtacaccagcaccctgctgccgccggagctgtccgacaccaccaacgccacgcaacccgaactcgttccggaagaccccgaggactcggccctcttagaggatcccgccgggacggtgtcttcgcagatccccccaaactggcacatcccgtcgatccaggacgtcgcgccgcaccacgcccccgccgcccccagcaacccgggcctgatcatcggcgcgctggccggcagtaccctggcggtgctggtcatcggcggtattgcgttttgggtacgccgccgcgctcagatggcccccaagcgcctacgtctcccccacatccgggatgacgacgcgcccccctcgcaccagccattgttttactag

SEQ ID NO: 656 - DNA, 270 bp, human herpesvirus 2
atgacctcccggcccgccgaccaagactcggtgcgttccagcgcgtcggtgccgctttaccccgcggcctcgcccgtcccggcagaagcctactactcggaaagcgaagacgaggccgccaacgacttcctcgtgcgcatgggccgccagcagtcggtcctaaggcgccgacggcggcgcacgcggtgcgtcgggctggttatcgcctgtctcgtcgtggccctcctatctggagggttcggggcacttttggtgtggctgctccgctaa

SEQ ID NO: 657 - DNA, 1914 bp, human herpesvirus 2
atggcgtcggcggaaatgcgcgagcggttggaggcgcctctgcccgaccgggcggtgcccatctacgtggccgggtttttggccctgtacgacagcggggacccgggcgagctggccctggacccagacacggtgcgtgcggccctgcctccggagaaccccctgccgatcaacgtagaccaccgcgctcggtgcgaggtgggccgggtgctcgccgtggtcaacgaccctcgggggccgttttttgtggggctgatcgcgtgcgtgcagctggagcgcgtcctcgagacggccgccagcgccgctatttttgagcgccgcggacccgcgctctcccgggaggagcgtctgctgtacctgatcaccaactacctgccatcggtctcgctgtccacaaaacgccggggggacgaggttccgcccgaccgcaccctgtttgcgcacgtggccctgtgcgccatcgggcggcgccttggaaccatcgtcacctacgacaccagcctagacgcggccatcgctccgtttcgccacctggacccggcgacgcgcgagggggtgcgacgcgaggccgccgaggccgagctcgcgctggccgggcgcacctgggcccccggcgtggaggcgctcacacacacgctgctctccaccgccgtcaacaacatgatgctgcgtgaccgctggagccttgtggccgagcggcggcggcaggccgggatcgccggacacacgtaccttcaggcgagcgaaaaatttaaaatatggggggcggagtctgcccctgcgccggagcgcgggtataaaaccggcgccccgggtgccatggacacatcccccgccgcgagcgttcccgcgccgcaggtcgccgtccgtgcgcgtcaagtcgcgtcgtcgtcttcttcttcttcttttccggcaccggccgatatgaaccccgtttcggcatcgggcgccccggcccctccgccgcccggcgacgggagttatttgtggatccccgcctctcattacaatcagctcgtcaccgggcaatccgcgccccgccacccgccgctgaccgcgtgcggcctgccggccgcggggacggtggcctacggacaccccggcgccggcccgtccccgcactacccgcctcctcccgcccacccgtacccgggtatgctgttcgcgggccccagtcccctggaggcccagatcgccgcgctggtgggggccatcgccgccgaccgccaggcgggtgggcttccggcggccgccggagaccacgggatccgggggtcggcgaagcgccgccgacacgaggtggagcagccggagtacgactgcggccgtgacgagccggaccgggacttcccgtattacccgggcgaggcccgccccgagccgcgcccggtcgactcccggcgcgccgcgcgccaggcttccgggccccacgaaaccatcacggcgctggtgggggcggtgacgtccctgcagcaggaactggcgcacatgcgcgcgcgtacccacgccccctacgggccgtatccgccggtggggccctaccaccacccccacgcagacacggagacccccgcccaaccaccccgctaccccgccaaggccgtctatctgccgccgccgcacatcgcccccccggggcctcctctatccggggcggtccccccaccctcgtatcccccagttgcggttacccccggtcccgctcccccgctacatcagccctcccccgcacacgcccacccccctccgccgccgccgggacccacgcctccccccgccgcgagcttaccccaacccgaggcgcccggcgcggaggccggcgccttagttaacgccagcagcgcggcccacgtgaacgtggacacggcccgggccgccgatctgtttgtgtcacagatgatggggtcccgctaa

SEQ ID NO: 658 - DNA, 990 bp, human herpesvirus 2
atgaaccccgtttcggcatcgggcgccccggcccctccgccgcccggcgacgggagttatttgtggatccccgcctctcattacaatcagctcgtcaccgggcaatccgcgccccgccacccgccgctgaccgcgtgcggcctgccggccgcggggacggtggcctacggacaccccggcgccggcccgtccccgcactacccgcctcctcccgcccacccgtacccgggtatgctgttcgcgggccccagtcccctggaggcccagatcgccgcgctggtgggggccatcgccgccgaccgccaggcgggtgggcttccggcggccgccggagaccacgggatccgggggtcggcgaagcgccgccgacacgaggtggagcagccggagtacgactgcggccgtgacgagccggaccgggacttcccgtattacccgggcgaggcccgccccgagccgcgcccggtcgactcccggcgcgccgcgcgccaggcttccgggccccacgaaaccatcacggcgctggtgggggcggtgacgtccctgcagcaggaactggcgcacatgcgcgcgcgtacccacgccccctacgggccgtatccgccggtggggccctaccaccacccccacgcagacacggagacccccgcccaaccaccccgctaccccgccaaggccgtctatctgccgccgccgcacatcgcccccccggggcctcctctatccggggcggtccccccaccctcgtatcccccagttgcggttacccccggtcccgctcccccgctacatcagccctcccccgcacacgcccacccccctccgccgccgccgggacccacgcctccccccgccgcgagcttaccccaacccgaggcgcccggcgcggaggccggcgccttagttaacgccagcagcgcggcccacgtgaacgtggacacggcccgggccgccgatctgtttgtgtcacagatgatggggtcccgctaa

SEQ ID NO: 659 - DNA, 2100 bp, human herpesvirus 2
atgcacgccatcgctcccaggttgcttcttctttttgttctttctggtcttccggggacacgcggcgggtcgggtgtccccggaccaattaatccccccaacagcgatgttgttttcccgggaggttcccccgtggctcaatattgttatgcctatccccggttggacgatcccgggcccttgggttccgcggacgccgggcggcaagacctgccccggcgcgtcgtccgtcacgagcccctgggccgctcgttcctcacgggggggctggttttgctggcgccgccggtacgcggatttggcgcacccaacgcaacgtatgcggcccgtgtgacgtactaccggctcacccgcgcctgccgtcagcccatcctccttcggcagtatggagggtgtcgcggcggcgagccgccgtccccaaagacgtgcgggtcgtacacgtacacgtaccagggcggcgggcctccgacccggtacgctctcgtaaatgcttccctgctggtgccgatctgggaccgcgccgcggagacattcgagtaccagatcgaactcggcggcgagctgcacgtgggtctgttgtgggtagaggtgggcggggagggccccggccccaccgcccccccacaggcggcgcgtgcggagggcggcccgtgcgtccccccggtccccgcgggccgcccgtggcgctcggtgcccccggtatggtattccgcccccaaccccgggtttcgtggcctgcgtttccgggagcgctgtctgcccccacagacgcccgccgcccccagcgacctaccacgcgtcgcttttgctccccagagcctgctggtggggattacgggccgcacgtttattcggatggcacgacccacggaagacgtcggggtcctgccgccccattgggcccccggggccctagatgacggtccgtacgcccccttcccaccccgcccgcggtttcgacgcgccctgcggacagaccccgagggggtcgaccccgacgttcgggccccccgaaccgggcggcgcctcatggccttgaccgaggacacgtcctccgattcgcctacgtccgctccggagaagacgcccctccctgtgtcggccaccgccatggcaccctcagtcgacccaagcgcggaaccgaccgcccccgcaaccactactccccccgacgagatggccacacaagccgcaacggtcgccgttacgccggaggaaacggcagtcgcctccccgcccgcgactgcatccgtggagtcgtcgccactccccgccgcggcggcggcaacgcccggggccgggcacacgaacaccagcagcgcctccgcagcgaaaacgccccccaccacaccagcccccacgacccccccgcccacgtctacccacgcgaccccccgccccacgactccggggccccaaacaacccctcccggacccgcaaccccgggtccggtgggcgcctccgccgcgcccacggccgattcccccctcaccgcctcgccccccgctaccgcgccggggccctcggccgccaacgtttcggtcgccgcgaccaccgccacgcccggaacccggggcaccgcccgtacccccccaacggacccaaagacgcacccacacggacccgcggacgctccccccggctcgccagcccccccaccccccgaacatcgcggcggacccgaggagtttgagggcgccggggacggcgaaccccccgaggacgacgacagcgccaccggcctcgccttccgaactccgaaccccaacaaaccaccccccgcgcgccccgggcccatccgccccacgctcccgccaggaattcttgggccgctcgcccccaacacgcctcgcccccccgcccaagctcccgctaaggacatgccctcgggccccacaccccaacacatccccctgttctggttcctaacggcctcccctgctctagatatcctctttatcatcagcaccaccatccacacggcggcgttcgtttgtctggtcgccttggcagcacaactttggcgcggccgggcggggcgcaggcgatacgcgcacccgagcgtgcgttacgtatgtctgccacccgagcgggattag

SEQ ID NO: 660 - DNA, 1473 bp, human herpesvirus 2
atggacctgttggtcgacgatctgtttgcggacgcggacggggtttcgccaccgccccccaggccagccgggggtcccaagaacaccccagccgcccctccgctgtacgccaccggtcggctgagtcaggcccagctgatgccctcgccgcccatgcccgtcccccccgcggccctgtttaaccgtctcctcgacgatctgggcttcagcgcgggtcccgcgctgtgtaccatgctagatacctggaacgaggacctgttctctgggttcccgaccaacgccgacatgtaccgggagtgcaagtttctgtcgacgctgcccagcgacgtgatcgactggggggatgcgcacgtccccgagcgctccccgatcgacattcgcgcccacggcgacgtggcgttccccaccctgcccgccacccgcgacgagctgccttcgtactacgaggccatggcgcagtttttccgcggtgagctgcgggcgcgggaggagagctaccggaccgtgttggcaaatttttgctcggccctgtaccggtacctgcgcgccagcgttcggcagctacaccgccaggcacacatgcggggccgcaaccgcgacctgcgggagatgctgcgcaccacgatcgcggacaggtactaccgcgagaccgcgcgcctggcgcgcgtcctgtttctgcatctatacctctttctgagccgcgagatcctatgggccgcgtacgccgagcagatgatgcggcccgatctgttcgacggcctctgctgcgacctggagagctggcgccagttggcgtgtctgtttcagcccctgatgtttatcaacggatcgctcaccgtgcggggagttcccgtggaggcccggcgactgcgggagctaaaccacattcgcgagcacctgaacctcccgctggtgcgaagtgcggcggcggaggaacccggggcgcccctcacgaccccgcccgtcctgcagggcaaccaggcccgctcctctgggtactttatgctgctgatccgggccaagttggactcgtactccagcgtcgcgacctcggagggcgagtccgtcatgcgggagcacgcgtatagccgcgggcggaccagaaacaattacggatcgacaatcgagggcctgctcgacctcccggacgacgatgacgctcctgcggaggccgggctggtggcgccgcgcatgtcgtttctctccgcgggacaacgcccccgcagactgtccaccaccgcccccattaccgacgtcagcctgggagacgaactccgcctggacggcgaggaggtggatatgacgcccgccgacgccctggacgacttcgacttggagatgctgggggacgtggagtccccctccccgggaatgacccacgaccccgtctcgtatggggctttggacgtggacgattttgagtttgaacagatgtttaccgatgccatgggcattgacgactttggggggtag

SEQ ID NO: 661 - DNA, 1110 bp, human herpesvirus 2
atgagtcagtgggggcccagggcgatccttgtccagacggacagcaccaaccggaatgccgatggggactggcaagcggccgtagctattcgcgggggcggagtcgttcaactgaacatggtcaacaaacgcgccgtggattttaccccggcagaatgcggggactccgaatgggccgtgggccgcgtctctctgggcctgcgaatggcaatgccgcgggacttctgcgcgattattcacgcccccgcggtatccggccccgggccccacgtgatgctcggtctcgtcgactcgggctaccgcggaaccgtcctggccgtggtcgtagccccgaacgggacgcgcgggtttgcccccggggccctccgggtcgacgtgacgtttctggacatccgggccacccccccgaccctcaccgagccgagctccctgcaccggtttccgcagttggcgccgtccccgctggcagggttacgagaagatccttggttggacggggcgctcgcgaccgccgggggggcggtggccctgccggccagacggcgcgggggatcgctggtctacgcgggcgagctaacgcaggtgaccaccgagcacggcgactgcgtgcacgaggcgcccgcctttctgccaaagcgcgaggaggacgcaggctttgacattctcatccaccgagccgtgaccgtcccggccaacggcgccacggtcatacagccgtccctccgcgtattgcgcgcggccgacggaccagaggcctgctatgtgctggggcggtcgtcgctcaatgccaggggcctcctggtcatgcctacgcgctggccctccgggcacgcctgtgcgtttgttgtatgtaacctgaccggagtcccggtgaccctacaagccgggtccaaggtcgcccagctgctcgtcgcggggacccacgccctcccctggatcccccccgacaacatccacgaggacggcgcattccgggcctaccccagaggggttccggacgcgaccgccaccccccgagacccgccgattttggtgtttacgaacgagtttgacgcggacgcccccccaagcaagcggggggccggggggtttggctccactggcatctag

SEQ ID NO: 662 - DNA, 1119 bp, human herpesvirus 2
atgcccggccgctcgctgcagggcctggcgatcctgggcctgtgggtctgcgccaccggcctggtcgtccgcggccccacggtcagtctggtctcagactcactcgtggatgccggggccgtggggccccagggcttcgtggaagaggacctgcgtgttttcggggagcttcattttgtgggggcccaggtcccccatacaaactactacgacggcatcatcgagctgtttcactaccccctggggaaccactgcccccgcgttgtacacgtggtcacactgaccgcatgcccccgccgccccgccgtggcgttcaccttgtgtcgctcgacgcaccacgcccacagccccgcctatccgaccctggagctgggtctggcgcggcagccgcttctgcgggttcgaacggcaacgcgcgactatgccggtctgtatgtcctgcgcgtatgggtcggcagcgcgacgaacgccagccggtttgttttgggggtggcgctctctgccaacgggacgtttgtgtataacggctcggactacggctcctgcgatccggcgcagcttcccttttcggccccgcgcctgggaccctcgagcgtatacacccccggagcctcccgacccacccctccacggacaacgacacccccgtcctccccccgagacccgacccccgcccccggggacacagggacgcccgcgcccgcgagcggcgagatagccccgcccaattccacgcgatcggccagcgaatcgagacacaggctaaccgtagcccaggtaatccagatcgccataccggcgtccatcatcgcctttgtgtttctgggcagctgtatctgcttcatccatagatgccagcgccgatacaggcgcccccgcggccagatttacaaccccgggggcgtttcctgcgcggtcaacgaggcggccatggcccgcctcggagccgagctgcgatcccacccaaacaccccccccaaaccccgacgccgttcgtcgtcgtccacgaccatgccttccctaacgtcgatagctgaggaatcggagccaggtccagtcgtgctgctgtccgtcagtcctcggccccgcagtggcccgacggccccccaagaggtctag

SEQ ID NO: 663 - DNA, 1467 bp, Francisella tularensis
atggttgaattaaaagtacctatgttcccagagtctgtagcagatggcacattagctcaatggaataaaaacgaaggtgactttgtaaatgagggcgatatcttggcagagattgagactgataaagttgttctagaagtacctgcaacatctagtggtgttttaaaagggataaaaaaacatgctggtgatacagtgctttcagaagagtcattagcgatcattgatactgctgtttctacatctgaacctaaccaacaaactactaatcaaggaaatgcttcagaagcaactgctactgggcaagaaattgatattaaggcgcctgtatttccagagtctgtagcagatggcacgatctcagagtggcataagaaagagggtgaggctgtttctgagggtgatatcttagcagagattgagactgataaggttgttctagaggttccggcaacatcaaatggtgttttgacaaaaatattaaaaacagcaggagagactgtactatctgcagagcttatcgctaagattacagcaggaggcgcaactgctactacgaaatcagaagcttcggtgggagtttctcaagcaaataatgatccgcatctagtaccttcagcacgtaaagcttttaatgcaagcggcttggatactgctgctaatatcgaaggtacaggtaaaaaagggcgtataacttctgaagatgtcaaaaaagcagttgcatcagtaaataaacctcaacaacagacagttgttataaatcaaggtgctagatatgaaaaaagagtcaagatgactcgtctgcgtcagactatagcaaataggttagttgaggttcaacatactaatgcaatcttaactactttcaatgaagtagatatgagtgcagttatggagcttagaaacaaatataaagatatgtttgtcaaagaacatgatactaagcttggctttatgtctttctttatcaaagcagcaacagaagcacttaagaaattcccagatgtaaatgcctctattgatggtgatgagattgtttaccataattattttgatattggtattgctgtaggtactgataggggtctagtggtacctgtactaagagatacagatactaaatctctagctgaattagaagccgatgttttagacaaagcgattaaaggtcgtgatggtaaattaagccttgaagatatgcaaggtggtacatttacgattacaaatggcggaacttatggttcgatgttatctacgcctattattaattcaccgcaaagtgctattttaggtatgcataatattgttgagcgtcctgtagttgttaagggtgagattaagattcgtccaattatgtatttagcgttatcttacgaccatagaatcattgatggcggtacatctgtaagattcttgaagatgatcaaagagctaattgaagatccaaatagaattcttctacaagta

SEQ ID NO: 664 - DNA, 1011 bp, Francisella tularensis
atgttgttaaaaaataattatttagtaagtattatattagtagtactaattatgatagttacaaaatcatttgcttgtgctgctacagattacaataaagtcgctttaattaatgtatcaacacaatattatccgaatgacataaaacaagcagagaaagcgcttaaagacaccggatataatactacttataaatatttagacatatatccttctgattttggatattctaatccagattcaataagagctaaaatattattagatgctcttttagataaaaatatagatattatttggttcttaaaaggaggaggtggagcatttaatttattaccttatctatatgatcatataaatgagcttaaaaaagctaaacctaaaatattagttggatttagtgatgttacagctatacatttttttgttaataatgtactaggatggaaatcattacatggtgtagtagctgcttataataagaatgcttatagctcacaaaaaataggaaaaattagaatcaatgacttagaaagaattcctaatattacagaaattataaacaatggcatatcatatgataaattaatgccaatgaataaaatggcttataatggtattgatggtagtattgttggaggtaatatgacgttgatatattcttatttctcaaccgtttaccaacaagatatctcaacaaaaattctatttcttgaagatactggcatttcatttagacagttagataggtcactacatcagttactttatctgccagaaaataaaaagcctgaagctattatatttggccagttttatccattagaccctaccgatgatcaaaggctcatatataaaactgtaattaaaaagtttgccaaaacttttaatagacctgtatattattttccttttataggtcatggacaatacaataaacctttattgcttggagttacatccaatattaaatgttctaaagaaactatattttgcactttaaaacaaaaa

SEQ ID NO: 665 - DNA, 1371 bp, Francisella tularensis
gtggacgttaagaagacttttttaaacattaaacaaaaaataaactcaagcaaaagaaactatgctatttttgttatcgcaactataattctagcctggcttgtgcttggaaaacttgggatatcattagcaattgtatattttatcttccaaattaactatatcaagaataagctccataaacttaaagataaaaaaactgcatctattgctattgtggttgcaaccctaatcctttttggagggatttttagttttgctgaatttattcaaagcatgattaaaaaaggcatggcagcatatgtaccccaacctgttgcagtaacatcatctgtagttgagaaaactgattggaaacaagttattaacactatcggtgaagctcaagcagttcaatctacagcgatatcttcacagtctggtgggattgttagcgaaattcatttcaagagtggtcaagaagttaaaaaaggtgatctactctttaagctagatactagccaacttaaagccaatcttgaagaagcgttatcaaatcttaaattagctaaaataactaaagatcgctataacaagctcgttgaacaaaaagccacatcaaaagaatctgccgataaggctaatgctgactatctatctgcgctagctcaagtacaaaatatagaatcacaaataggctttaaagaggttagaacaccttttgatggtaagattggtattagaaatattagtttgggacaatatttcaacaatggtgataatgctgcaacacttactacaattgatcccattttcattacattccctgtacctcaaaataaagtaagtatgataagcgttggtcaagaaataaacttctactccgactcatatcctggtgaaacttttactggaaaaataacagctattaactcatttattaatgactccaatagatcaattactgttcaagcaacatatgcaaatcctcatcataagattgttgcaggaatgtttttaacagttcatgttagtttaccagttagaaagaactctattgtaatacctcgtaatgctatttcatatagtctttacggtcaatcagtatttactctagaaccggtaatgaaagatggtcaacctgtaaaagcatcttatacatctactgctgatggtggcatgaaaaccatcaacacagataaaacactatacaaagtaggtcaagcaaatatcgaagtgcttgaaacaagaaataatctagctttagtcacaggtttagaaccaggaacaacaattattacatctggccaaaataaagtccataagggtatgaatgctatcataaacaatagtgtagaaattgacaacaacatatacaagcaaggaattcag

SEQ ID NO: 666 - DNA, 471 bp, Francisella tularensis
atggatttattaaaagcaattgatagagtggctgagattcttaactcaagtgatataaaggaaatcagaattaaagatggtggttcaagcatttttatgacaaaaaataatacagctgctattacaagtgtagtttttgctgcaccagttgctagcaatgttgcttcagcagctccagcagtagctactgctgctacttcggcagcagctcctaaagtaaatctggctgaagaaataagcggtgaagagatcaagtctccaatggtaggtactttctatggcgcatcttcacctgatgctgctccttatgttaaagaaggtcaagaagtcaaaaaaggcgacgtattgtgtatcatcgaagcaatgaaaatcatgaacaaaattgaagcagaaagagcaggtaaaattgttaaaatcatcgctaaagatggtgagcctgttcaatttgatcaacctctatttattattgaa

SEQ ID NO: 667 - DNA, 276 bp, Francisella tularensis
ttggtggagtttttgctaaataaaaatgatattaagatgagtagtttattagatattggatgtttgtttttaattgccttgattattacttgtatattttcaaaaggttatttgagatattttattgttgcattaacgattgtctattatcttataggtaatggggttttagggaccattttagccttaccacttaaatcagaatctactgatataaaagcttgtgcaaacactaaagggattatcctcttaggtgctggtatcaataattttcgg

SEQ ID NO: 668 - DNA, 717 bp, Francisella tularensis
atgaaacataaattattttataagttatttattttatttgcatttctatttatcacactagatagctttgcagagagtttcaaacagtataatgtttatctaatcccagatactacagctgataaatatgttaaagaatttgatgattctttagctaaaacaaatgtactagagaaatacaaaactacgccttttatcaaaaaccatcctgtacatttgacattatatttaacaagttttcaaagcaagtatattaaagatattaacagtcaattagctaatcttgctaagaatacagaaccattttatatagaaaccaatggttttagtgctggtaaaagtggttttgtaatgcttgatatcaaaaactctcaatcattacagcaattatcaaacgttgttataaaagacttagctaagtatagagataaagactaccctgctccaagctggattaaattctatccaagtaaattagtatcttttgaaaaatatggttcgccaaatgcttttgcagaatttaaccctcatataagtatattagccgctaatttacaaacagatcaagaaagagataactttgacaaagattttaatgagattattaaaaatacgaagttagaaccaattagctttaagattaaagcaatcggttttggtgaagttgatgaaaatgggcaagtaactaaaattctacatatttataaactaaataag

SEQ ID NO: 669 - DNA, 687 bp, Francisella tularensis
atgaaaaagagtattatcccaattactttaataagtatttttgcaacgacatcgcttgctatagcttgtgataatgattatttagatcataatacaattaaatattctactcaagccgaaactacagtaaagagtgacagtatacttgttcaggttacagggtatgcaacaacaactcttgaaaaacaaaatgatgtagaaaaacaaatttcagataatgtaaataatattgttaaatctgaatggaaagtgaaaaatattgagcaaactactagtaatagtggcacaattaatataactgttaaactacaagcgagaatatcgcaaagtgatcttaataatctgcaaagagcatttgaaaaccaaaataaatcttcaggtatgagattagttgtagatgtattagattacaatcctcctgctagagatatacaagtggctaaacaaaaactgatgataaagctttttaatgatactaaagattaccttgctaactttaataaacaaactaatagtaattatactattcaatctatacaatatattgatgttgataattatcaacctagaaataatttagtgttaatgaaaacggcttatagtggtgatgcaaattcaaatagctctaatccagtagccgtaactcaagatatcaatattaaagcaaatgttacatttatggagaaa

SEQ ID NO: 670 - DNA, 1893 bp, Francisella tularensis
atgagaaaaattaaaactattttattagtaaatatcttattttctattttatatatcaatatatcatttgctaattttgctaaaaatgaagatatgggtgcaaactatgaatatgttaataataatatttttatcgataataattataaagttgattggactgtggaggagcaaataaatattttcgatgaaaccgctagaaattactataaacttgttcaattatattaccttgaaggttttgaaagacttaaggttatcaatgcaagtattgaaaataataacaagaaatatgaaatcgataaaagtttaattgaagataaaaatcttgctagtgaaataaatggcttcacaaatacaagacagatctctattccttttaaaaaaattcaagtgggtagtaagattaaaataaaatatcatgacataatagaaaaaccgatcttagataatcatttctcaacaactttgtattatgggagtgatattcttctaaaaaattcaataactactattaaatctaaagttcctttatatatatctactaatgacccttttggtgttttagagttaaattattttgaaaaagataaaacttattattatagtattaagcttctaaagccaattaatagtgtcactgttaacgagccagaaaatagtattttaagctccaaaaagcaaacatgggttagtatatctactgatgtgacatatgagaaaataaatgaaacacttgtgaataaatatgaaaaccttatacatcaacaaatccgtgatgaacttttagacgatttacaagcattaaaccaacaaaaactaaaacctgatatagaaattatagataatgtaacaagcctaattcagaataagataacatacctaggaggttggaaaaaaatcgatgctggtatttatccaagaacaatggaagatattattgatactggttatggtgattgtaaagattattctttgttgacaatcgctagcttaaggtatttaggactgtctgctagatttgctctagtaaatagaggcgagataattcaagaatattctgataaaaccctgcctagtattaataattttaatcatgcaatagtatatgttaaaggctttgatgaaaaagagtattggattgatccaactaataatattagtatgacaaatggattatttcctgatatagctaatcgtaaagcattaattctagatcctgaaggttttatttttactcaaattcccaacattgattataaaaaatctaaaatagtttcaatctttaaatatgatttagaagaagatcttatttatgttaaaaaggatattactcttaaaaaagaggctgctattatgtttaccggattagaattatttacaagcaaagatattattgaggatagcatctataacagtttccttgaagatgaaagaagcattcctaaatcgcaaagagtcaagtctgttattccaaatttaaactctaggatagttaaaaatatagatttctcgttcgaatatatattagataacccatatcttgtaagtaacttaggaaaattattatcattaaacagtaattatagttttatcagtcctccagaagatagtgtaaatgatatatatataggccctcctattactgtaataaaaaagtatatctttaatacaaagattaatggtatagataaattgaattcgacactatcaacaccatggatagatttaaatagaaaagcatatataagtaaagatggagagagtattatagaacagcaatatataattaaaaagtcttttttaagttttgaagataggcaatcagaacaatataaactcttgaaaaaaggatttgataagtcatttaaaaggttatttttaatactaagc

SEQ ID NO: 671 - DNA, 354 bp, Francisella tularensis
atgagaaaattattattgtcactatctgcaatcgtattatttgtgtcaacttcatttgcacaaggagcagagcaagctgctggtagtccgttaagctcaatcttaatgctagtggtattttttgctatattctggttcctattaatcagacctcaacaaaagaaaaacaaagaattgcgtaagatgctatctgagctatcaaaaggtgatgaggttgtaactaacggtggaatggtaggcaaaatcgctaagatagatgaaacatttgtagatttagaagttgcagataatgttactgttaagattcaaagaaatgctgtagcaaatattttacctaaaggtgctactaaagct

SEQ ID NO: 672 - DNA, 414 bp, Francisella tularensis
atgcagcgacttgagcttaaagtatcgccaagataccgcaatattatttatgcaagtttagtgtttattagtggttttgtgattgctagttactttggtaatactattattggttattttgggtttttgttgattctagtttcgctattttttgtgataatagaaggtaagttttttcttgaggctatcattatcccgaatcaattagagagtacttcactaatatttgtaattaatggtagtgaaactgatttttggcttattaggaaacatattgttataaatggctggatatttttatatgctattcaacaaggctcaaataaaaaagtaaaaatgtggctgcataaatctaattttaaacagcaaaatgatattaaagtattagcaaggtatattttatttaaccaaaaa

SEQ ID NO: 673 - DNA, 582 bp, Francisella tularensis
atgattataagtaaaaagaaaggcttctctttagttcagactatggttgttatttctatcatgacaatacttatgatggcggcaattagctcgtttactttttactataagacttttgctgaaacacgcttaactaatttacaaaagttaatagaatatggtgtcattaaagctcgtactgataataaaactgttattgtatgcgcagcgacaccagatagttttgatggaactggtaagttagatggaaacagttttgcatgtgcaaactcaacttcatgggttgatgatcctatcgtagcatttgagagcgctgatggaactgatatttataatggtgctgaagatacaataatagctaatatgccacaaggacatggtggacatatctatgttaacctggcaggaaatcctagttctataaggattaatccaaatggatttatggcaacaggtaatggtaatatcacttattgtgataaatcaaataagtatcaggcagcactgattacaaatctagttggtagggtggtttatactgatagccctactaaagatggtggcggattgtatacctgcgaa

SEQ ID NO: 674 - DNA, 1893 bp, Francisella tularensis
atgtctatagagatagttaaagtccctgatattggggattatgataacgttgatgtgatcgaggttaatgttgctgtaggtgatgttattgctgaagaagattcactaattacgttagaaacagataaagcaagtatggaggttccatctccatttgcaggtaagatcactaaattaactgtaaaagttggtgataaagtttctcagggaactgcaataatggaagttgaggttgagagtgctgctgatcaagctgctactacacaatcacaacctcaaacaactagttcagctcctgtagctgctacgacgaacctgattgttgatgtcgaggttccagatattggcgactatgatagtgttgatgtgattgaggtgtctgtaaaagtaggtgatgagatagcagaagaggattcgctaattacgcttgaaacatataaggctagtatggaagtaccatcgcctgtagcgggtaaggttgttgaagttattactaaggttggtgacaaggtttcacaaggtagcttgattttaaaggttgaaacaggctctagtgcacaagctccagctcaagaacagtcacaacaatctgcaccagttaaatccgctgctgaagaaattattgatgtaaaagttcctgatatcggtgattacgatagtgttgatgtgattgaagtatctgtagctgttggtgataagattgaagaagaagattctttgattacattagaaactgataaggcaagcatggaggttccgtctccagttgctggtgaagttgttgaaataatcacaaaagttggtgataaagtttcacaaggtagtttaattcttaaggtcaaaacacaaggttcagcaccggtagagcaaactagttcacaaccagcgccagctaaacaagagcaagctaaacagcaagctgctacacctgctgctccaacgccagcatcaagttcggtaaatgagtatgctgtagataattctaatgcacatgcgtctcctgcagtgagaaagctagcacgaattctaaatattgatctaagtaaggttaaagctacagggcgtaaaggtcgtgtaacaaaagaagattgttataactatattaagcatgctgtcacacaagttcaaactggtaaggtcgctgctagtggtagtggtttagatcttttagatgatcctgttgttgattttgctaagtttggtgagattgaaactcaaccattatcaagaattaacaagattagtgctaagaatttacatcgtaactgggtgaagattcctcatgttacattctatgatgatgcggatgtcacagacttagaagagttcagaaatgctaagaaagcctttgctgagaaaaaaggtattaagattacacctttatcattcttggttaaagctgctgcagttgcattacaagagttcccaagatttaatagctcattatcaaatgatggtgagaacttaattatcaagaagtattataatattggttttgctgcagatactccagctggtttaatggttccagttgtcaaagatgctgataaaaagggtatcattgaaatatcaaaagatattatggagttggctggcaaagctcgtgatggtaaacttggcgcaaaggatatgacaggtgctacatttactatctcaagcttaggcgtgttaggtactacgtcatttacgcctattataaatatgccagaggtggctattatgggtgtatctaagacagcagtgaagcctatttggaatggtaaagagtttattcctagaactatgctaccattatcattatctacagatcatagagtgatagatggcgcattagcagctaaattcttaactagatattgtcagattttatctgatttacgtgaaatcataatg

SEQ ID NO: 675 - DNA, 606 bp, Francisella tularensis
atgaaaaagaaacttttatttataactatatctgctagtttagcattagcgcttagttcatgtggcaaaactactgtagcatatgaggatccaaatggtgttgatgcaacatcaataaattttagttcaacatatttacaagctatcacaaataagatggctgaagatatgcttaactcacccgcagttaaaagaattactgctatggatacacctacattattctttagtaatatccgtaatgagactcgtgagcatataaatacgactatgttgtcaaacactgctcaaacacagattataaaatcggggctattccaagttacagatatgtctcagatcaaaaatgttcgagagcagcttggctatcaagcaaatagtggaatggttgaccaagctactgcaactaagattgggcagcatattggtgctagatacatggtttatggctctatccaagatattgataatactaatgttgatggtgataagagatctaaattcttcttagctacactgaaaatgatggatctaaaaacaggtcttgttgtatggcaagatgataagcagattcgtaaatctcaaactaaatcgacttttggttgg

SEQ ID NO: 676 - DNA, 1632 bp, Francisella tularensis
atggctgcaaaacaagttttattttcagatgaagctcgtgcaaaaatgctagatggtgttaacacactagcaaatgctgtaaaagttactttaggtccaaaaggtcgtaatgttgttttagataaatcatttggcacgcctactatcactaaagatggtgtatctgttgctaaagaaattgaactagaagataagtttgagaatatgggtgctcagatagttaaagaagtagcttcaaagacagcggatgttgctggtgatggtactactacagcgactgtacttgctcaggcattattgacagagggtctaaaagctgtcgctgcaggtatgaatcctatggatctaaaaagaggtatcgacaaagcaactgctaggttagttgaagaattaaaagcactttctaaaccatgttcagatccaaaatcaattgagcaagttggtactatctctgctaactctgatgctactgtaggtaagcttatcgctgacgcaatggcaaaagttggtaaagaaggtgtgattacagttgaagaaggcaaaggctttgaagatgagcttgatgtagttgaaggtatgcagtttgatagaggttatctatctccgtattttgcaacaaatcaagagaatatgactactgatttagagaatccatatattctaatagttgataagaaaatctctaatatccgcgatttattaccgatattagaaggtgtttctaaatctggtagagcgttactaataatagctgaagatgtagaaagtgaagctctagctactttagttgtaaataatatgcgtggtgtagttaaagtatgtgctgtcaaagctcctggctttggtgatagaagaaaagctatgctagaagatatcgctactctaactggagctacgtttgtatcagaagacctaagcatgaagttagaagaaactaacatggagcatttaggtacggctagtagagtacaagtaacaaaagataatacaacaattattgatggtgctggtgaaaaagaagctatcgctaaacgaataaatgtaatcaaagctaatattgctgaagctaactctgattatgatcgtgagaagctgcaagaaagattggctaaactttctggtggtgtcgcggtgataaaagttggtgctgttacagaagctgagatgaaagagaagaaagatcgtgtcgatgatgctttacatgctactcgtgcggctgtagaagaaggtattgttgctggtggtggcgttgctttaattagagcacaaaaagcattagatggcttaacaggtgaaaatgacgatcaaaactatggtatagcgctacttagaaaagcaatagaagctcctctaagacagatagtatcaaatgctggcggtgagtcttctgtagttgttaaccaagttaaagctaatcaaggtaactatggttataatgctgcaaatgatacttatggtgatatggttgagatgggtattttagatcctactaaagttactcgttcagctctacaacatgctgcttcaattgctggacttatgatcactacagaggcgatgatcggtgagatcaaagaagctgctcctgctatgcctatgggcggtggcatgggcggtatgcctggcatgatg

SEQ ID NO: 677 - DNA, 1527 bp, Francisella tularensis
ttgcaaactacccttatatccataatgagtaataaggtattagatacatattataaaaacaatcgacatatttgggtgctagtactatctggtgctgttataggcacaatgattggtcttctagcaacagcatttcagctactcctagactttatttttaaaattaagctggctcttttttctttcagtggtggtaatctttttatcgaaatcgctatgtcaatatcattaagtattgtgatggtattaatttcgatttttattgttaaaaaatttgctaaagaggctggtggtagcggtatccaagaggttgagggtgctttaaaaggctgccgcaaaatacgtaaaagagttatgcccgtgaagtttataagtggacttttttcgttaggctcaggtttaagtttaggtaaagagggaccatcaattcatatggctgctgcattagcgcagttttttgttgataaatttaaacttactacaaaatatgctaatgcggttatctctgctggggctggagctggactagcagctgcttttaataccccactttctgggattatctttgttattgaagagatgaatagaaagtttagatttagtgtttcggcaataaagtgtgtgctagtagcatgtatcatgagtacagttatctctagagctattatgggtaatcctccagcaataagcgtagaaactttcagctcagtaccacaaaatactctttggttatttatggtattagggattatatttggttattttggtttactatttaacaaatccttaatcaaagtgacaaactttttctcagaaggctccaagaagaggtattggactttagttataattgtttgcataatttttggtattggtgttgttctatctccaaatgctgttggcggtggctatattgtcatagcaaatactcttgattataacttatcaatcaagatgcttttagtgctttttgtacttcgttttgctggagttattttctcatatggcaccggcgttactggtgggatattcgcaccaatgattgcgcttggtactgtttttggactagattatggtttatcagtggcgcaactcttccctcagtataatattgaacctggagtttttgcagttgctggaatgagtgcactatttacagcaactgtaggtgcaccattaacgggtattgtactagtaatggagatgacttggaatttccatcttttacttcctttgatgataacttgctttagtgcatctatgctgacctatattcatcatcaaaaaccaatatatgataccctattaagacgtactatttctaacgaaagaaaacaacaagcaaaggaaaaaatgagcgcaatcaaaagccaactccaaatacttcaggacaaactatctcaaaagaagaaatataatcacgcaatttctctaatgcactgggacttagaaacacaagcccctaaaaactcaatcaacacaacatctgaagttattgggtttttcagtgaaaaaatctatgaaata

SEQ ID NO: 678 - DNA, 1302 bp, Coxiella burnetii
atgaaccacgaaaatcaggaatcttctgcccgccttttgttcaatcgtcgtgtcatgacggtgctgttcctcagtttttcttccacgttgccgcttgtgttgctaaccggaactttacaagcgtggtacaccgcggccggcgttagccttatggtcattggaagcttgagccttttgcaatacgcttatttggttaaatttgtgtgggcgccttttatggatcggtatgcgccgctcggattggggcggcgacgaagttggattttgttaacgcaaatcagtcttgccggagcgctggcggttatggcttttatgaacccggcgtatcatccgtgggaattattttggctgtctgccgtggtggcgtttatttctgcttcgcaggatgtcgttatcgatggctatcgagtggatgttttgcgccaaaaagaacgtggctttggggtggcagtgacgacggtcggtggtcgaatggcgatgttggtggggggcggattagcgttaattttggcggcagattatggttggcgggccacttacttaaccatggctttattaatgctgatccaaattattccgactttgaccgcacctaatcctgaaaaaccggtctatcctccggtaacgctgcacgctgctgttgtggcgccttttcgggaattgttgacccgtaaacatatcgttatgattttgctgctggttttaatttataaatttggcgatgcactcgctttagctttaaacacgacttttttaatgcgcggcgttggttttacgctcttagaattgggttatagttataaattaactagcgtaatcgcttcattattgggtgggtttgccggcggattttttatgccgcggttagggctttatcgatcgctaatggtttttgggtttttacaaaccgtgactaacctttctttcatggtgttggcgttggtagggaaaaattttcccgtcatgataggatcgattttttccgattatttttgcggcggcttatcaacagccgctttcgttgcctttttaatagcgctttgtaagcgggaatactctgcaacgcaatatgcaattttatcggcattaatggccgtaagtcgcgtggtgattgggcccgtcgctgcttatctcgtcaagcatatggggtgggctcctttttatttaatcactttttttgcgggttttcccgccttattgattttacgctggttacgggaccggattgattttagcgcggatacgctgcatttaaagggaaacccatcccaaaaaccttctcctcgcagggtagccatataa

SEQ ID NO: 679 - DNA, 696 bp, Coxiella burnetii
atgtcggtaaaaaaactagtaacacttgctactctcactatggctagcgttggtgtcacttccgctgcattggcgggtggtcctgattatgtacctgctcccagctacgcgggcgtttatcttgaaggtaacttgggttatgcataccgtccgtggcggaaggatgcaaccactgttgtaggtctcgcgaaacaagctagacttttaggaagttcttctcgaggcaacggtggctttactttcggtgcggatctcggttatcaatttaaccagtacttcgccgttgaaggcggttggttctatctgcctaaagtgaaattcacaaccactggcgttgtaaatggacttgcggcaggaacatacacagttaaaagcgggatggcttacgctgcattgaaagggatggcgcctgtttatgaaaacacttatgttttcgggaaattaggcgttgcttacacctacaatcgagctaacgccggtctgccgactaataaaattccggcaaccttcggttcacgttccagattttggaacccgctgtttgccgccggtgttcagtactacttcacacctaactggtctgtgaatgctcagtacacgttcgtaccgggctatcgaaatgcttcatctaagcgttttgtagcgccagttacccatctgttcaccgtaggccttggctacaaattcttaatgtaa

SEQ ID NO: 680 - DNA, 615 bp, Coxiella burnetii
atgaataaaaagaaaactaatattcccaaggagcgatgcgcctgggtaagcaacgatcctctttacattcattatcatgacctggaatggggagttcccatctatgacgaccgattattgtttgaatttttaattttagaaggaatgcaggctggtttaagctggttgactattctaaaaaagcgaaacaattatcgagactctttcaataatttcgacgcatcaattatttcaaagtacaacccgcgtaaaatagaccgcttattagaaaatgctggcattattcgcaataaattaaaaattcaagctaccataaacaatgcaaaagcgtttttggaagttaaaaaggagtggaggaacttctccgattacatttggcattttgtcgatgggcatcccatccagaatcagtggaaaaatgccaagcaaatacctacccgatcagctatctcggatgttttgtccaaggatctgaaaaagcgaggatttaagtttgttgggagcacgatttgttatgctttcatgcaggcggtggggatggttaatgaccatacaacgaattgttttcgctacgaagaaattaaaaacttgccaatcttgctgtccccagcgtaa

SEQ ID NO: 681 - DNA, 579 bp, Coxiella burnetii
atgactttacttatcatcctcctaatcttaataatattaatcggtggttatgccatttctatttataatcatttaattggcttaatcgaatctatccgcaacaacaataaacaaatcgatatccaactagatcgtcgttataaagttttcgaatctttaattgaggtggttaagaaatacatggattacgaacgctctacattgaaagatgtggttgctttacgtaatcaagcgcaaacggcaaaacaagcaggggataacgacgcgcgtatgaaagcggaaaataaaatatcgacaatattatcaggattacatgttgtttttgaacaatacccggatttaaaagccaaccaaaatgcctttcaattacaagaaactattgtaagcacggaaaataaactggcgtacgccaagcaagcttacaacgatagcgttgagcgatataatgcaaagaaaaaaatggtttttccttcaatggtggtcagtgcatttcccagtaagttgaattttgatttcccttattggcaattgccacctgagaaaataattaagcaagaagattataaagtaaacttgtag

SEQ ID NO: 682 - DNA, 1023 bp, Coxiella burnetii
atgaaaaaagaatttttaaaaacccgaacacctgcgaaattaattctttccggcgaacacgccgtggtttacggtcaccccgcgctttcagtcgctattaaccgttacatggaagccacggtgcggtggtctttaccgctgcatttttcttttcattttatgggaattgattttcgccgggaagtcactttacaggcacttcgcaacttaaaaagaaaacttaaaaagcaataccataaatacagcttgggtcacctgagtattcgggaagtgctgcaaaaaccttttgaattgtcgcttttcacgttcattaacgttcttgatcgattaaaaaataaattgccaacgggcatcgatatcgtcactgattccaatattcctgtcggttgtggaatgggttcctccgctgccagcgttgtaagcttgatctatgcactgacccaatttcttgggatggatttacatttggaggactatttatccctcggtgtggaatcagaaaatttgcagcatggctattcaagcggtctcgatgtacataccgtctatcacggcggttgcctgcgctatgagaaagggcaatttgaaaagcgtcctatccctgatttcccaatgcaattaatacaaacgggctgcccacaaagcagcaccggtgaatgcatctccgaggccgctcctttttttaagaatagtaaaattggcgaagatttttctgcggtgactaatgcccttgatcaagctttacaaaatcacaataacgacagcattaaaggctgcattcgagaaaatcatcgactattgcgatcgatcggcgttgtccccgataaaattaataactttgtcattgacgtggaaaaactcggcggtgctgcaaaaatttgtggcgctggtagtgttgttggcgataatgggggtattgttttagtcatcgctgatgatctcattacagatttagcaaaacagtacggttactccatcattcccattcaaaccgacagtcaagggacttgtattatcgaataa

SEQ ID NO: 683 - DNA, 498 bp, Coxiella burnetii
atgattaaacgcttgttatctgctatctgtttatctgtagccatgatttggagtgtagctgctgttgcccaaacggttgggcttgtcgatatgcgtcagatttttcaaaccgcgccgcagattaaggacatcaatacacgattagaaaaacaattttcgcctcagcgagaaaaaatgactaaattaactcaatcactgcaacagaatcttcaaaaattaaagcgcgatgaagcggtgatgggtaaaaaagaggctgaaaatttgcgtaaagaaattcaaaatgatgaaagcacgcttcgccagcaacaacaacagtttcaacaagaactattcgtggcgcaaaataaagctatgtctgactttatgtctaaggttaacggtgccgtaaagagagtggccgagagagaaaatctcgatctcgttttgcctaaagataccgtactttatgccaaaaacagtaaggatattacttcaaacgttgtatcagcattgaaataa

SEQ ID NO: 684 - DNA, 1146 bp, Coxiella burnetii
atggaaaaaactacgtgcaaatcgttaaaaaatcaatacctattccactgttttttgagcattaaagacccgcgtgttccagggagatgtatttacccattgattaatattctcctcatcacgctttgcgccttgatttgtggggttgatacgtggaaagggattgccgactttggtaagaaacgctatcggtggctcagtcaatttgtcgatatgcgctgtggggttccaagcgcactgacttttgcgcgcgttttttcattaattgaacctgaacaattccaacattgtttgtcggcttggatgagtcagttttttcaattgttgcgctttgacatgattcatctggatggaaaaagcctttgtggttcagcgaggagaggcaaagcacaaaaagcaacccatattgtgaatgcgtaccttcccaaagaacaagtgacgctgggagaagttcgggtgcccgataaaagcaatgaaataaaagccatacctattcttttaaatagcttgaatgtccaaggctgtattatcagtatcgacgcgatggggactcaaaaaggcattgctaatttaattcgcttaaaacaggccgactatgtactggcacttaaaaaaaatcacacacgattttatcgttatgtggaacgattgtttagctgcagtgatgagagagattatcaaggcatgtgttatcgcacagaagaaaccaaggattatggccatgctcggattgaagaaaggagctattgtgttttgccgatgatgtatcttcataaatacaaaaaatattggcgtgatttgcaggcgatcgttcgtgttcaatcaaaacggcataaagggaatgaaatagaaacggccacccggtattacatcacttcattaccctttgcagaacatagaaggatgtctcaagccattcgtcagcactgggctattgaaaatcaactccattggaaattggatattggtttgggcgaagacgcctctctcattacgcgaggctatgccgatcagaatctcgcaacgcttcgaaaaatggtgctaaaaatgctggaaaacgaaaactcttccaaacaggggatcgctggaaaacgcatacaggccgctctttctacacgatatttaagaaaagtggtagggttttga

SEQ ID NO: 685 - DNA, 285 bp, Coxiella burnetii
atgccgaaagaaactaaaaccgactctattaagcaagagttcgctacgtttagtgacgatgtcgctaaattacggggcgatctcagtagtattattcacaaattaacttcatttagcaaaacggaggctagcatgatgaaaaataactttgtcaatcgaggaaaggatgtcattcattcagtagaaagcaaatgcaaaaagaaaccgttagcaactctcgggtacgcattcggcgctggaataatcactggaataattagccgcaagatcgctcgaagaaaatga

SEQ ID NO: 686 - DNA, 168 bp, Coxiella burnetii
ttgccgccagtaataaagacccaaaattttaaagcccgccatgccggcaaattcgtcactcccgcgcaaattcgtcatccccgcgcaggcggggacgtgcgcagcgcaccttcggtgctgcctcggcctgacggcacattcaaggaggaattgcaccagttcgcttaa

SEQ ID NO: 687 - DNA, 1047 bp, Coxiella burnetii
atgaaaaaacgcacaaaaattattatcaccttgggggtggtaggctgctttattgcggctggtcttattttttcacataaaaaagcacaggcaacccccaacaggcctcccctgttagtaaaagaaagtcctgttgaggtggcggatttacccattattgctacagcaacagggacattagtcgctaataaccaaaccaatatcagccccaaagtggcgggctatgtgacgaaaatcgccttttcgcctggggattttgtgacggctggatcggtgcttattcaacttgacaatcagaaacaaaaaaatgacttagcggccgcgaaagccgacgtcgaattaagtgaattgcaataccaacgcgatgctttggctttaaaaaagggacttattttacaaacgaccgtgtacagcgataaagtcagtctcgataaagacaaggccctcgctcagacggatcaaacggcgttgcaagacatgacattgagagcgcctttcagcggctacctcggcgccaagcaattcagccttggcgattatgtcacgccaggacaaaaattagtgaccctcgtggatcaacaaaaattaaaggtagtttacgatttaccgaaccatttcgcgccacaattacaaataggccagccggttactgtcactgctgattttctgccggggcaacgattcaacggtaaagttaattatgtcgccccttatgtaaattctgattcgcaaaccatcgaaacacaggctctattaaataataaaaatggtgccctaaaacctggccagtttgtcaccgtttctcaaactttagaaaccttaaaaaaagctattttgatacctgaaaatagtttatttgcaaacatgaatggtcattacgtgtttaaagttaaaaacggaaaagccatttcaacaccggtcaaagtcggagaacgcctttatggaaaagtacaaattatcgacggcttaaagccaggcgatcacattattacgactggacaagatcaaatttataaaagtggagcaaaggtaaaagtggttcattaa

SEQ ID NO: 688 - DNA, 375 bp, Coxiella burnetii
atgattacaaaaaaaccaataaagaaaccacttatactattagtcgaagataatccgttcattcaaaaaattcatgttcaattgttgaaaaaattaaattgcgaagtgacgttggctatagacggccaatcggctttagctctttattcggataaattcgatctcatttttttggatattaatctttcagacatgaacggtatggaggtttgcaaagcgatacggcaacgcaccagtagcacacccattattgctttaacttcagagagtagtaagaacaaaccccgctatttttccacgggaataaatgattttattaaaaaaccaactacccaagcagcgttaaaacgagtactcaactattggattcagtga

SEQ ID NO: 689 - DNA, 249 bp, Coxiella burnetii
atgaaccaaaaagttaaacgtttataccgttcccgtaccaatcgtaaaatcgctggcgtctgcggcggattagctgaatacttcaatgtagatgcgaccattatgcgcttactcttcatcctagtggtcttgttctcggtagggtttggcatcattgcctatatcttaatgtgggtcatcatgccagaagctccggaagaaaagggaagaacgatagatcacaacgaggttaaaggtccacaagagtaa

SEQ ID NO: 690 - DNA, 1017 bp, Coxiella burnetii
atgagtagacgtgagactcccactagcacaatatcctcaacgccgacaggaactcgaacgccgagaaggagattgagccgaaaaggacatcctgtaagaagaagcccgttaatagcaaagaattcgatatttactgtattcgatttatcgtttgaaatactcataaatgctgtagaagaaaacagcttagacataataaaaaactaccttcgcggggattcttttcatcagacggcgaaatggggcctcaacgtaccgccaaagacggatttccagggtgacacgctcttaataaaagcggccaagaaaggaaagtttcttattgccaaagcattattggaggctggcgcttacaaagagatagtcaataagctaggagaaactgccttaatttgtgcggtacgccattttcgagtagagacgctcgatttattaattcagtatcatgctgatgtgaaaatcaaatataaaggacagaaccttttagaactgactctcgagaaatattccgaaaagactaaaaattttactttgcgcattgtccaatccttagtggctgcaggtgtagaactttggcattctgatggaagtcaaatcatggctagcgataaggaaattgatgaaataattagaaatgccagaaaccttcaaatcataaaaaaggagaaacgagaggcagaagaacgagctcgaacaaaaaaatcgaaacaaataaccttacagcgtatacagcgcgaccttgaatacatcagtaaacgtcttccttttgaagaaaatatattaacaactcctgattttcctcagcttttcttcgagatttctaagttggttgaaattatttccgactctcaaaaagaaaataaagaagaattcgctgaagcttctatttctctgatagatgccttaaaaaactttggtatgatcctggaaaaacgcgatgttccaggagaagtgaaaaaagaagacacaacgctgtctagaaacaactctctctcttgtctgtctagtcctcggtga

SEQ ID NO: 691 - DNA, 414 bp, Coxiella burnetii
ttgaatatgaatcattatttacagttaatgggtattgatgtatggcgtttgcgaacgcctgtttcaaatcactattaccattatgatttgctagatactcaagacaggcaagtcggagtgttgctggctgatgcggtattgaaagacgaaaaagaaagccaactcgttgagaaaattgcaaaagcgacaaaaaaacagattagaggaggtcttaaggaagggaggccaaacccggagaaattggggcaatgcgtcattattttgttagggaatcgcgtaacccaatctttttctcaggtgaactttccgcagataatcacaagtcattcgcctgccgaattactacgcgacggcgatctcaagccaaagacatggaacgctttaaagaaagcaatgcagttgatggaagcgtga

SEQ ID NO: 692 - DNA, 939 bp, Coxiella burnetii
gtgaaacggtatcttttttttactattatctttttcattcctatgcttggtctggctgcggtgtccgaaatgaacgcaagcacaccggtacaatcctttcaagaagccgatagccaaacttcctcaccttcggcggctttacccgtaacccctcaagctgagaagccaacggctaaggaagttccagagttgaacgaaaacaaaagtcccgataatacagctcaaaatcagacacctaaaaatgccacccctacggccattccccctgcttctaaaaagtcggtgcctgaaacaggaccaagtacggatgacgtctctgcatccgctaacgcggttgtgagccatgactcttcggctatgcttcaggcagaacttactcaaatgaaccaaaacagtttgcaatttcagcagcaaacagacggtcgtttggagcaactgaatagtcaaaaccaacaattacagcaacgattacaaaacttggaaaaagtagtgacgttgctcaatcaagaattagtccaactcaaacaaggcagccaccctgtctcccaactacagccccaaaatcctccatcccaaagctcttttaacggatggattgcgtatttaaagcaaattttaggagaaaatgggtatagggcagctatcggtgggatgttcgttgctctacttctaatactgtgggcactttggccgcgtaaaagaaaaaatcaaaaaaaccgcagggttttggatgatcaaccagcgattggcggcgctgacgaagcggaatatgattacatgggaagtgctgaaagtattcccgcgaaaattaatctggctcggacttatattgcgatggaagacccggtatcagcgcgtaaagtgctcaagcaggtaagcgaacaggggaatgaagaacagcgccaggaggccgatgagcttttaaagagcctgccttga

SEQ ID NO: 693 - DNA, 333 bp, Coxiella burnetii
atgagaagctttatttatattttaattttactacttctgatctttgcgtttagcaccttgattaaacgtcacgatcaccttcggcaagaaaattcgtgtttacatatccgtaaaaccttactggcgaaaacattaaaaccgaaagacacttatatcccccagtgtaccctttatggtcattatattccaaagcaatgtaatcaaagcacgggagaatgttggtgcgcgacaatagaaggaaaagaaattccgggtacacggacttcctcagggaaaacgccgaaactgtgcaaactgaattggttttatgaattgtatcgacgaatgcaatga

SEQ ID NO: 694 - DNA, 390 bp, Coxiella burnetii
atgtcaataaattcgattatttttacggcgttagtttgttttgctctaattctccttatcattgccatttctatgtttggtcgagggaaagatcgattagacgattcgtcatggaaaagtgataataacgatcaaatttacgtgggtaatttaccctatcatgtagtggaaaacgatttgcatcaatatttttcccgttttggggcgattgaatctgttaaaattgttagaaattttcgtacgggccgttcaaaaggctatgcgtttgtgacgtacgttactccaaaacaagccgttaaagcgttagacgctcatggcaaagatttacaaggacgatctttagtggttcggattgctaaatcaagagagcagcaacacgcatacacgtaa

SEQ ID NO: 695 - DNA, 531 bp, Coxiella burnetii
atgaaaaaatgtctgttccctaattttttattttttgtttttgtaacgagtgcacaagcttcagttttccaacgggggacttattatgaggtctgtttcacgccgtatcaaaattgcactggggaaattgtaaaaatgattaatcaggcgaagcaaagtatttatgtacaaggttattcatttacctccgatcctattgcgaatgcattagttcgagcaaagaaacgcggagttaaagtgttggtgattttagataaaagtcagttcgcgggaaaatattattcttcggcggggtatttaatccgcaatggaataccggtatgggaggattttcaattggatattgcccataacaaggtaatgatcgttgataaagccgtcgtcgaaacagggtcgtttaattacacggtgtctgcccaacattataatgccgaaaatgtgttaattattcataataaaacgttggcccaccgataccttgctaattggtatcgccgccaaaaagcctctaaattggtgaaaaaatattag

SEQ ID NO: 696 - DNA, 318 bp, Coxiella burnetii
gtgaaaatctgccctgcctacttgcatcgctccaacaagccctgttattttaataataaaagagagattaccatgtcaaaatttttacaccgtttatgggaaggaatcatgccaattgtgggcatgattgttttcgttattctttttatcgtggggatatttattttttcctatcttctaatcatcgctgccgttattggattgatactttttatcatcgcctttattcggataaaattagcacaacgtaaacgacccaaagaacccccttctggtagaatcattgagcacgataacgatagagagaataaatcttga

SEQ ID NO: 697 - DNA, 351 bp, Coxiella burnetii
atgagtctattgagtgtattaggcgtaggggtcgtttatgctgcaccagtcacagctcaagcgccgcatccgggcggtttttggtccatgctgtggttgccgctcctgttaattctggtgttttattttctgttaattcgtcctcaaagcaagcgagctaaagaacatcgacaattgctggaaggtatttctttaggtgacgaggtggtgacgacagggggcgttgttgcaagggtatcgcgattgaaagacaattttgttgtccttgaaattagcaaaggtaccgaaatcactgtacagaaagcttctatagcctctgtattgcccaaaggcacgatcgattcgatttaa

SEQ ID NO: 698 - DNA, 729 bp, Coxiella burnetii
ttgcgcttacaaagagtcttttcattcctttttttggtgcccttttactcggcaatcgttttctatgttcgcttcgtacggcgatacaagataaaaaacaaacacaaaatcagaaaacaatttcggggctttctgaagaaagagcacaaaggtccggtgctcatttgtgcaaaccacctcagttactttgatgcttttggcattatttggggtttaggttcgctctggggatatcttaggcattttcgccgctttccctggaatattcccaatgcaaagtttgcgtgcgctaacttattcaatcgactaatgagttatatgggtaaaatgatccctcttaaaacagaggggggaggatcgaatgcgaaaaccgtattaagaagggttacacatttattaaaacgaggagatttcgctatgatcttccctgaagggacgcggagcgagacagggcgattgaatatggacgattatggttacggggctggtcagattttgcaagctgtccctcaagcaaaggtcttattaatttatttgcggggtgaggaagacaaaatgcaacggtatttaccccagaaaggttgtcagttttatatgaaattaaaatggttcgccccccaaacccaaacgaatcagcagggccgacaggggattcgtgaactttcaaagaagataatggaagagttatgtgaaatggaaaaagagtatttccaggaaattccttcctaa

SEQ ID NO: 699 - DNA, 612 bp, Coxiella burnetii
atggaaatcaatctcccacgttcggacagcgccgcgaagacgcccggtatcctcttgcgcgaggctcgccaggcgaagaatcttcagcaaagcgatgtcgcgaaagagatacggcttagcattcaatgggttaaagatcttgagcaagacgattattctcatgttcccgcgttaatttacgtccgcggttatttacgtggctatgcccgttatgtgggtatttctcccgatgaggtgatggcagcttttgatgagatgggattggaagaagagttcgagcgagtgaaagccgaagtagaaagacccgtgaaacaccacgcggtgcccgtcgtcttaagatcgaaacggatgattaacggcaaaatggttcggtgggttacggttattttattagtggcgctgattgtctctgtgggcgtttggtggcaaggcaaaaaacatattcttgggcaattgcaatcagttatttcttcgccgcaagagaatttgcccttaaaacaaacgtcagtgaattcagtgaatactaataaaacgatcaacacaaatttgacggagcaacccacggccataaaatacaagaataagataactttttcaggaactaatcattga

SEQ ID NO: 700 - DNA, 1218 bp, Coxiella burnetii
atggctatagaaattaaagtacctacgttgcctgaatcggttagcgatgccacggttgcaaagtggtataaaaaagaaggcgattccatttcacgggatgaaaatctagtcgatttggaaacggataaagtcatgttggaggttcccgccccgaaagacggtgtggttgaaaaaatcgtcgcgaaagaaggcgaagtcgttaaagccgatcaaatccttgcccttttaaaagaaggcggcgctgtggccaaagaaaaagaaaagaaagacgaaaaagaaacgaaaaaagaaaaagagaaaaaagaagaaaagaaagataaggaaaaaaaggaaaaaactgaagaaaaagaatctgatctcagtcccgccgtgcgacgtatggtttcggaaaaagacgttgatgtcgaggaaattgaaggaagtggaaaaggagggcggattacgaaaaaagacgtggaagattatttagaaaaacaaaaagagaaaccctccgaaggaaaagaagggcctgccgatgaacgcacggaaaaacgcgtgcctttatcccgcatccggcaacgtgttgcggagcggttagtgcaagtccaacaagaagcggctttattaacgacgtttaatgaaattaacatgcagctggtaatggagttgcgaaaaaaataccgcgaagagttcgaaaagaaattcaaagttcgattgggttttatgtccttttttaccaaagccgtcgttgaagcgttaaaacgttttcccatggtaaacgcctcgatcgatggtagtgatattatttatcacaattattacgacatcggtattgctattggcactgaacgcggattaattgtccctattcttagaaacgccgaaaaaatgaatatggccgatattgaaaaacaaattcgtgaatacgcttctcgagctcaagaaggtcgtttgaatattgaggaactaacgggaggcacttttacaattacgaatggcggaacttacggctcgcttctctcaacgcctataattaatccgccccaaaccgctattttggggatgcataaaataatggaccgtccaacggttgaaaacggagaagtcgtggttcgtccgatcatgcaagtggcattatcttacgatcatcgggtgattgacgggcgagaagccgtgttatttttagtgaccattaaagagcttttggaagatccagctcgaatgattttggagtgttaa

SEQ ID NO: 701 - DNA, 657 bp, Coxiella burnetii
atggatcaaactgaacgtgaagaaatttttcgtcgctttaaagcacgcaatcataaaccggtctccgaattaatttatcattctgagtttgaattattaatttcggtaatgctatcggcacaagccaccgacatcagcgttaataaagccactaaagatttataccgcatcgctaatacgccggccaaggtgttagcactgggtgaaagcggattaaaaaaatacattaaatcgattggcctttataatacgaaagctaaaaatattattaaaacatgcaaaatattagttgaaaactatcactccaaagtaccccgaacgcgtgaggaactggaagctttacccggcgttggccgcaaaacggcaaacgtgattttaaacacggcatttggcgaacacgctatcgctgtggatacgcatatttttcgtgtggctaaccgcaccggtttggcgcgaggaaaaacgccgctggctgttgaaaagaaattaatggaagtagttcctaaaaaatatttagcagatgctcaccactggctagttttacacggccgctatatttgcatagcacggcggcctaaatgttctgaatgcttaattaatgacttgtgtgaatatcccgataaaacgcctctcaacttatccaatcccacggaatga

SEQ ID NO: 702 - DNA, 450 bp, Coxiella burnetii
atgattaaaaaacttattttattcgtttaccgatattcgctaattcgattccttactatcggcgttattgggttgcttattgacattacttttctttatctatttcgacacgaaatgggattaatacctgcaaaaatactctcttatgtaattgcggttacaatcacttggttcttgaatcgctgttttactttccgctcacaagattcgcggcgcgttcaggaatggatgcgttacgcttttatttatgcaataacaggctgtattcatgtattgatgtttactgctctcgtgtatcgttacccagttttgcacacgcatccaatcttcgccttgattattacggcggttgttattgcctttattaatttcggtttcacaaagtatttcgcattcaaaaagcgttcgattgccgagccttctttgttcaattcccatcaagcgatttga

SEQ ID NO: 703 - DNA, 528 bp, Coxiella burnetii
atgtacccgcctcgttatattaaagaaaccttgataaaagatgaaaaattagtttattttacacgcccccattggattatttacggccctggcgtgattgcattaatttttgcggctttattttatacgtatggtcctgcttattttattttgcgctctcgattactgggtggttatccgctttatgacctttgcagtttttttgcgttcgcgttgggcgctttttggttgttgacggcgtatgttacctatcgaacttcggaatacggcgtcaccgataaacgcgtcattatgaaaaaaggttggattcgacgaaactccttggaaatatttttacgccggttagaaggcgttgacgtcaaccaaacggttacggggcgaatcctcggctatgggactctcgtgatcagtggtatgggcggatcgcgcgattattacacgaatgttcctcaaccgctgatgttccgtaagtatgtgcagcggcaagtggacttattgattgatgcatctgaggaagctcagtcttaa

SEQ ID NO: 704 - DNA, 654 bp, Coxiella burnetii
atgtcaaaaatcaagtggtttttaggggtacttgcttttcctttttgctctgctttcgcgcaaacccaaacaataccggattttgtcgggggcattaataggcacaccgctaaaatttgcacccaagaaattgaaaaatcccgttgcaaattaaaagatttattcaccaattataaactttgtgtgcatgaggtgttggtgcaacatccacagtgcaagcagtctcttacgtttttcaactccacggagggcggtatttttaataaaatacgctcatataaaaacatcgatatcatcctagctgattatgtttatattgcggaccaaggcacgggctactttctggtaacccattcgggccaattcattgtactccctttacccattactaaaaaacaattaaaaacaatgtccaattatgaggtaatcgcgaaaaaataccctcatgtgaatgcgtggcaaatactcgattttccccaggaaataaaacttccaagaaatcgttaccgtctcgttttcactcaacaattaaaagatggttgcaatgcctgcgcactcgccggaacggtcaaggtggcttatgatttttccgacgacgggaagcattttgatggaattaaagtgcttaaattaagtccgcaaaatactatctga

SEQ ID NO: 705 - DNA, 1332 bp, Coxiella burnetii
atgcgcttgctcattgttaccatcagtttattcatttcattgaacgtttttgcgagtgaatccacaccccttgtaaatattcaacattgggaaacaaaaaacggtgcgaaggtttatttcgttcgagcgtcggaaattccgatggtggatattcaagtcgtgtttgcggctggttcgtcgtacgatggtcaggcgtgggggttagcttcttttacaaactcaatgttagcagaaggaacgacaacacagaatgcaaatcaaatcgccatggcctttgaccgcgtcggtgctcaatatagtaatggtgttgatcgcgatatggcgatgctcagtttgcgaagtttaacgagaccggattttttgaaaccggcgttaaaaacttttgctgatgtcttgacagaatctactttcccgcaaaaagcttttattcgagtgaagcaccaattgttgtccagtattgaatacaacgaacagtcgccaaacgttgtcgcttcaaaagctttttattcggctatttatggaacacacccgtatgggcatcctccggcgggaacgataaagaccattaatgccataacgaatgatgaagtgaaatcgttctatcaaaaattttacgtcgctaataatgctaacgtagtgattgtcggcgatttaactcgcgaacaagcacaaggaatcgccgcacaagtgattggcgctttgccaactggaaaaccggccccggtgctacccgaagcgataacagcaagcggtgtgttgcggcaacaaatcccttttttagcgcaacaaaccacgattattttaggacaagtggccattaaaccggccagcgctgattatttccctttggtagtcggcaatcaggtattgggaggattgcctttatcttctcttttatttgatcaagtgaggaaccaacgcggattgacttacggggcttatagccaattggcgccgttaaaatacggcggtcccttttatatttctttacagacccgcaaagataaagcagccgatgctttaaaaatcacccagtctgttttacagcattttgtagaaaaaggacctacgttattgcaactacaagcggcgaaaaacaatatcatcggtaactttccgttgcaattgtccacgaatgcaagcgtattggcgaacgtcactaatatggttttttatgggttgcctttggattatttggatacttatcgtcagaatatccgagcggtagatacgcagcaagtgaccgcagcattccagaagactattcgccctgcccagttaaaaatcgttgaagtaggatcgtcaactcctctgaaagggggagaagaatag

SEQ ID NO: 706 - DNA, 1701 bp, Coxiella burnetii
gtggatattaaacgaataattttatatgtcattgttgcgcttttagcgattgcgctgttcaacgcttggcagcgtgactatccaccgacgccgaagccaactccaacggtagaacagccaaccgcgaatggcgatcacccgaccgcttacacccctccagctttcactcccggggcggctgagaaaactaaaaaggcaggaacgattgcctttacgagtaaagtgccggaggcgcggctgatcacggtaaggactgatgtccttgatgtcgaaattgacactcagggtggaaacattgtttcggcaaagttgcctaaatatccggtttctttagaggagaaacaaacgccggtacaaattttaagcggcgaaccgaatgagttgtacattgctcaaagcgggttaacaaatggaaatggtcaaccaacaacggttcaatttgagtcggaaaaaaagcaatatgttttagaaaatggccagaatcagctcatcgtccaactcacaggtcgagcccctgacggacttctagttacgaagacctacacgttccatcgcgatgattatgccattcacttagcctatcaagtgaagaacaacacgtctaaaccctggcaaggcagcctttatactcaaattacccgccgtcaaccaccaacggaacatcaccatttttatgtcagaagttacaacggcgcctctatgggaagtccgcagaccccctatgaaaagctgagctacgaatcgctggataagcaaaatattgatcgaacgagccaaagtggctggatcgccatgcaacaacattacttcctgagcgcttgggtaccggggaaccccgaattaacgtaccactactacagtcacgtgattccagcgagcgatgagcctaatgtttacgtggttggttttgtcagccctcaaatgaatgtggccgcggggagcgaagccgccacgcatgccacgctttacgtcggccccgaaattgctaagcgattaaaggggttggcacctggattggaacgaacgatcgattacggatggctatggccgatttccatgcttttgttttggattctcagcgctgttcatgctgtcgttaagaattggggttggtctattattatcacgacgattctgatcaaaatcgttttttattggttttcagcaaaaagtttccgttcaatggcgcgcatgcgtgaaatgcaaccgcggatacaagcgttgaaagaacggcatggcgatgatcgacaagcgttaagtcgcgcgacaatggagttgtaccgcaaagagaaaattaatccattgggcggctgcctcccgatgctaattcaagtacctgtatttattgctttttattacgttattattgaaagcgtccaattgcgtcaagcaccgtttattttctggattcatgatttatccgttaaagatccctattatattttgcccattatcatgggtttaagtatgttggctcaacaatgggtatcgcccacttcaccggaccctacgcaacaaaaaatgatgtggattctgcccgtgatttttacagtctttttcatcaattttcccgcgggattggtgttgtattggatcaccaacaacgtggtgcagacgctgcaacagtggtatgtcaataaaacgtatgaaagccataaagcgaaattaaaagcgcggcgcgctcggaagcggaaaaggtaa

SEQ ID NO: 707 - DNA, 1308 bp, Coxiella burnetii
atgttttttaaaaagctaaaaacaaaaaaggcaggcgttattgcttgggctttttatgattgggccaattcctcattttcgagcattattctaacgttcgttttcgctgcttactttacagaaaaagtcgccgtgaatcgcattttaggcacaacgcaatggagttatgctgtggctattgcgggatttatggttgcgttattgagtcctttttttggcgctattgctgaccatgaaggccgacgtaagccctgggtcatgttatttgcattgctatcgatattttctgccggcctgttgtggttcgccaaacctgatcccgcttatgtggcttggtcgttaatttggcttattttaggcgaggtggggctggaagtgagtatggttttttacaatgccatgctcggagatttggccccatcccactattggggtcgagtttctggatgggcgtggggattgggttattttggcggacttttcagtttgataatcacgctattcctctttgttcccgggcatgtggcgtggctcaataaaggagaagccgaacagatacgaattgttggccccttcgtagcaagttggtatttcattttctcattgccgtttgtctttttgacgcctgatcgcccaacaaaaggcattacttatcgaaaagccattcggttaggagtaaaacaactctggcaaactttacgtcgattgcccaaatataaagaagtctttaagtttttgattgcccgtatgatttatatcgatggcttaaacaccatttttgctttcggtggaatatacgccgctggggctttcaacatgacttttggccaagtcattcaatttggaatcgctttaaacattgctgcagggctgggagcgattgggttcgcgtggttggatgattacgttggagcaaaacccacggttttaatctccttagtcattatgctgattggcggaatagggatggttctcgtgaaaagtcaattggctttttgggtattaggaatgttgctcagtatcgcggtgggaccagtgcaggcggccagccgctcgttgatggtgagattagcaccggcgcacgtgaggacggaaatgtttgggctttatgccttttcaggaaaagctacggcgtttgtcggaccttggctggtgggagcattcacttttgccttcgacagtcaacgaatcggaatgagcacggtactgtggtttttgcttattggcggcgttcttttattcttcgtcaaggtaccgaaaaagcagcgccgcttaaaaggaaaagaaatcattttgacttcaatgtaa

SEQ ID NO: 708 - DNA, 303 bp, Coxiella burnetii
atgaatatcgctcaattaattgcaagtgtacaaggcctctcagcaatcgctgccggtttatttatcgggctcgccgcgatgggaaccgctattggtttcggaatgttaggcggtaaattcctcgaaggggtggctcgccaacccgaattatctaccatgttaatgattcgtatgtttttaatggccggtttggttgacgcttttgccgctatttcgctggtgatggggttgattttaatttttgcccgaaatccatttttaaatgccgttgttgaagcggccacgcgagcgacgggccattga

SEQ ID NO: 709 - DNA, 99 bp, Coxiella burnetii
atggtaacttttggtcgggataaacttcttgtgccgcatattgttgctatcacaggcatgcgccgctgtggaaagtcaacgctgatgctaaagccttaa

SEQ ID NO: 710 - DNA, 1242 bp, Coxiella burnetii
atgcccctgctggtttgcggcattaatcatcaatcggcgcctttaactgtccgtgaaaaactggtgttcacgcctgagcgcacgcctttagctttacaaagtttactggcagaaaaagccgttaacgaggccctgttgttgtctacttgcaatcgcacagaaatttataccaccgtcgatgaagcggcgactattctccgttggttgtcaaagcaaccgcaattatcgggcatcgaccttcgctctttttgctatgcgcgccgcgacatcgaaatggtgcgccatgtcatgcgcgtaggaagcggattagattccatggtcttaggtgaaccgcaaattctagggcaaatgaagcaagcgtatttattggcgcgccgaataggcgctgtgggcagtgagctaggtcgcctctttcccgccgtttttgcggcaactaagcgtatccgcagtgaaacagccattggagccaatcccgtttccatagcgtatgctgttgtgcagttggcgaaacgaattttttctcatctgaaccagtgtcaaatattgttgattggggcaggtgagacgattgaactcgttttttcgcatctatacaaccaaggcgcgcgtcatttttttattgctaatcgcactttaacgcgggctaaacaaattgcagaaccctatcacgctcaggctattcgtctgtccgacatcccgacgtatttacctaaagtcgatattgttattagcgcgacaatgagtcaattgcctttagtgggaaaaggcgcagttgaaagcgctttgcgccagcgtaaacgtcggcctctttttatggccgatctcgccttaccgcgtgatattgaacctgaaacagctcaattagaagatgtctacctctataatattgacgacttgcaaaccctcatcgcacagaatcgccaaacccgcgaagcggccgctaaacaagctgaggctatggtggaaatgcaggcgatccattatatgcgccaattacaggtgcacaaagctggcgatacgatacgccgatttcgggagcgggtggaaatgcttcgtgatcaggagttggagaaagcactggcgcattttcagcggaccaacgacccaaaagcggtcatcgctcacttcgcccacaatttaacgaataaaattttacatcagccgacaacaaaattaaggcaagcagcgtatgaagatcaggtacaattattattatcagccaaagaattatttgatttatga

SEQ ID NO: 711 - DNA, 1230 bp, Coxiella burnetii
ttgcataaatttcgcctctcgggccgtaaaacgactatacgctataaacaacatatgaaaaaaaacctgattgttatcttaacctctgtattcgttactgtgggtcaattcgccatggcgctttatttgccggctttgcccgctttaaccacctattttcacaccttccccggcgtcatccagttgagtttgaccttatttctcatcgcttttgggttctctcaattattttatggttctttgtctgattgttatggccgaaaacctttgctattgattgggctcgttattgtcatgataggattcctcatcgctgttttcgccaggcatctttctttgttgctgatagctcgagtggttcagggtttaggagcgggttcggtttcggtattagcccgcgcggttatccgcgatcgatttgaaggggaaaaattagtccaagcactttccctcttaattatggcggcttccctggctccaatgattgcaccttttatcggcggccatattcaacaccggctgggttggcattcgatttttatttttttattcttttattcaggtttaattttattaggcatcttctttttgcttccggaaacaaaaaagaccgaatcggttccttttaaaatgggcgctttgctcaacaattataagttactgcttagacaccctatttatatcaaatacgttgtgtgtattattatggcctacgcttgtcaaattctttatttgtcaatttctccttttatttttcaaaacggattaaagctgaatgctgctcaatacagtactattattacgctgccggccatcgggtattttgtgggaaactttctttctacacgattgataaggttttttgacagcaaccatttggtatttgtaggcgcattaattgtggtgatggcgggaatagcactggctttagaagctgcttttaatggcttatccgctttttctgtcattactcccattatattctgcgtcattggcatcggcttaatatatcccaatgttattagcggctcactttctccttttccgcaaatggcaggcacagcggccgctttgtcaggcgccatacaaatggcaggtacaagcagtatagcgggcgttaccaatgcgttacacgtcgtcagcgttttggggctcgggatttcatttttactttgcggcgcagttgttctgttgatgatatttcgtattatgaggacgtccgttcaatga

SEQ ID NO: 712 - DNA, 444 bp, Coxiella burnetii
atggcggtatcgaaagcgatgaaaacgaaaacaactgatcttggtttttcgccctataaattaacgcggggcgaggaatatatgaacgaaaaacagcaggaacatttccggaaaattttgtctgaatggaaaaagcagctgatggaagaggtcgactctacggttgtccatttgaaagaagaagccagcgtgtatgcagatccgttggatcgggccagccaagaagaaggatttaatttagaactccgcacccgcgatcgtgaacgaaagctgattaaaaaaattgagcaagcagcagacgcgcttgataacggtgattatggtttctgtgaagattgcggagccgaaatcggcattcgtcgattagaagcgcgccccacagctaccaaatgtattgattgtaaaacttttgaagagattcgcgaaaaacaatccggtggataa

SEQ ID NO: 713 - DNA, 639 bp, Coxiella burnetii
atgtcttttttagctattaatgtcatgaaaaaaattctaattttgctattattgatttctcttctttttttggacggttgtcattcaaaatcgcccccgcaaaacctacaaaatgtgtgcgaaatttttcagcaatatcccgaatggttttgggcagctaaaacaacgcgtcatcgttttggaattcctatcagcgtgcaaatggccattatctaccaagagtctcatttcaattctcatgccgaaccaccgcgccaacgattattgggttttatcccttggtttcgaccaacgagcgcctcgggttatgcgcaagctgtcgatgggacatggcggcgctatttaaaagcgataggcaaattgagcggtaatcgtaatgattttagtgacgctatttattttatcggttggtatgccaatttggcccacataaagttaggcatttcaaaaaccgacgccttctctatttatttagcctatcacgaaggcattaaaggctttcgaaaaaaaacctatcgacataataaaaaattactgactctagcctcccatcaagtggcaaaacaagcacaccattatcggattcaactattgcgttgcgaacccagtctgccacaaaaaccatggtggaaattttaa

SEQ ID NO: 714 - DNA, 2676 bp, Vaccinia virus
atgatgcctattaagtcaatagttactcttgatcaattagaggactctgaatatttatttcgtatagtttctaccgttcttccgcatctatgtctagattacaaagtatgtgaccaacttaaaacaaccttcgttcatccgttcgatatattgcttaataactcattaggatccgtaactaaacaagatgagcttcaggctgctatatccaaattgggcattaattatttaattgataccacgtcacgtgaattaaaactgtttaatgttacacttaacgctggaaatatagatattattaataccccaattaacattagttcggaaactaatcctatcattaatactcacagcttttacgatcttccacctttcactcaacaccttcttaatattagattgacggatacagaatacagagctagatttatcggtggttatattaaaccagatggctccgactcaatggatgttctagcagaaaagaaatatccagatcttaactttgataacacttatttgtttaacatcctctataaggatgttattaatgcaccaataaaagaattcaaggcaaaaattgttaacggtgtattaagcagacaagattttgataatcttataggtgttagacaatatataacaatacaagatcgaccccgctttgacgacgcttataacatcgcagatgctgctagacattatggagttaatcttaatacattgccattaccaaacgtcgatctcactactatgccaacatataaacatctcatcatgtttgaacagtacttcatttatacatatgacagagtggatatttattacaatggtaacaaaatgctcttcgatgatgagattataaactttactatttctatgcgatatcaatctcttattcctagactggtagatttctttccagatataccagtaaacaataacatcgtacttcatactcgcgatcctcaaaatgctgcagtgaatgtaaccgtggcgcttccaaacgtgcaatttgtggacataaatagaaacaacaaattctttattaatttctttaacctgttggcgaaggaacaaagatctacggctatcaaagttaccaaatccatgttttgggacggtatggattacgaggaatacaagtctaaaaaccttcaggacatgatgtttataaattctacctgttatgtattcggtctttataatcacaataatactacttattgctctatcctttctgatattatctccgcagagaaaacacctattagagtatgtttgttacccagagtagtcggaggtaagactgttactaatcttatttcagaaactttgaagagtatttcatctatgactatacgagagtttcccaggaaagataaatctatcatgcatataggactttctgagacgggattcatgagattcttccaactactcaggctcatggctgataaacctcatgaaacggctattaaagaggttgttatggcttatgtgggtataaagttgggtgacaaaggtagtccgtactatattagaaaggagtcataccaagactttatctatctgctattcgcatcaatgggctttaaggtgactactagaagatccattatgggaagcaataatatctctatcatcagtattagaccaagagtaactaaacaatacatcgtcgctacattgatgaaaactagttgtagtaaaaacgaggcagaaaaattgattacttcagcgtttgatcttctcaatttcatggtatcagttagtgactttagagattatcagagttacagacagtatagaaactattgtcctagatatttctatgcaggatctcccgaaggagaggaaaccattatctgtgactcggaaccgataagtatcttggatagaattgatactcgtggtatcttttctgcgtatactattaatgaaatgatggacactgatatcttttctccagagaataaggcatttaagaataatctgagtagatttatcgagagtggagatattacaggagaagatattttctgcgcaatgccatacaacatcttagataggattattacaaatgctggtacgtgtaccgtatccataggtgatatgttggataacattacaacccagtcagactgtaatatgactaacgaaatcacagatatgataaacgcctcattgaagaatacaatttctaaagataataatatgctagtcagccaagcgttgaactctgtagctaatcgttctaaacaaaagattggagacttgaggcaatcatcgtgtaagatggcattgttgtttaaaaatcttgctacatccatctacacaatagaacgtattttcaatgctaaagtaggcgatgatgttaaggcatcgatgttggagaagtataaagtattcacagatatttccatgtcattgtataaagacttgatagctatggagaatctcaaagcgatgctatacattattcgacgaagcggatgcagaatagacgatgcacaaattactactgacgatctagtcaagtcttactcattgatccgtcctaaaattctaagtatgataaactattataatgaaatgagtagaggatactttgaacacatgaaaaaaaatctaaatatgacagatggtgactctgtctcttttgatgatgaataa

SEQ ID NO: 715 - DNA, 957 bp, Vaccinia virus
atgacgaccgtaccagtgacggatatacaaaacgatttaattacagagttttcagaagataattatccatctaacaaaaattatgaaataactcttcgtcaaatgtctattctaactcacgttaacaacgtggtagatagagaacataatgccgccgtagtgtcatctccagaggaaatatcctcacaacttaatgaagatctatttccagatgatgattcaccggccactattatcgaacgagtacaacctcatactactattattgacgatactccacctcctacttttcgtagagagttattgatatcggaacaacgtcaacaacgagaaaaaagatttaatattacagtatcgaaaaatgctgaagcaataatggaatctagatctatgataacttctatgccaacacaaacaccatccttgggagtagtttatgataaagataaaagaattcagatgttggaggatgaagtggttaatcttagaaatcaacgatctaatacaaaatcatctgataatttagataattttaccaaaatactatttggtaagactccgtataaatcaacagaagttaataagcgtatagccatcgttaattatgcaaatttgaacgggtctcccttatcagtcgaggacttggatgtttgttcagaggatgaaatagatagaatctataaaacgattaaacaatatcacgaaagtagaaaacaaaaaattatcgtcactaacgtgattattattgtcataaacattatcgagcaagcattgctaaaactcggatttgaagaaatcaaaggactgagtaccgatatcacttcagaaattatcgatgtggagatcggagatgactgcgatgctgtagcatcaaaactaggaatcggtaacagtccggttcttaatattgtattgtttatactcaagatattcgttaaacgaattaaaattatttaa

SEQ ID NO: 716 - DNA, 213 bp, Vaccinia virus
atgattggtattcttttgttgatcggtatttgtgtagcagttaccgtcgccatcctatactcgatgtataataagatcaagaactcacaaaatccgaatccaagtccgaatttaaattcgcctcctccagaaccaaaaaataccaagtttgtaaataatctggaaaaggatcatattagttcattgtataatctagttaaatcttctgtataa

SEQ ID NO: 717 - DNA, 612 bp, Vaccinia virus
atgagttatttaagatattacaatatgcttgacgacttctctgcgggtgctggagtgcttgataaagatttatttacagaggaacagcagcaatcgtttatgcctaaagatggaggtatgatgcaaaacgattatggaggaatgaatgattatttgggaatcttcaaaaataatgatgttagaacgttactcggtttgattttgttcgtcttggctctatatagccctcctctaatctctatattgatgatatttatctcatcttttctattgcctcttactagcttagttattacctattgcttagtaactcaaatgtatcgtggaggtaatggcaacactgtgggaatgtctattgtgtgtattgtagctgctgtaattattatggcaatcaatgtatttacgaattcacagatatttaatattatttcttacattattttgtttattctgttctttgcatatgtgatgaacatcgaaagacaggactatagaagaagtataaatgtaaccattcctgaacagtatacctgcaacaaaccttatactgcgggaaataaggtagatgttgatataccaacatttaacagtttaaatactgacgattattaa

SEQ ID NO: 718 - DNA, 333 bp, Vaccinia virus
atggacggaactcttttccccggagatgacgatcttgcaattccagcaactgaatttttttctacaaaggctgctaaaaagccagaggctaaacgcgaagcaattgttaaagccgatgaagacgacaatgaggaaactctcaaacaacggctaactaatttggaaaaaaagattactaatgtaacaacaaagtttgaacaaatagaaaagtgttgtaaacgcaacgatgaagttctatttaggttggaaaatcacgctgaaactctaagagcggctatgatatctctggctaaaaagattgatgttcagactggacggcgcccatatgagtaa

SEQ ID NO: 719 - DNA, 558 bp, Vaccinia virus
atgatgacaccagaaaacgacgaagagcagacatctgtgttctccgctactgtttacggagacaaaattcaaggaaagaataaacgcaaacgcgtgattggtctatgtattagaatatctatggttatttcactactatctatgattaccatgtccgcgtttctcatagtgcgcctaaatcaatgcatgtctgctaacgaggctgctattactgacgccgctgttgccgttgctgctgcatcatctactcatagaaaggttgcgtctagcactacacaatatgatcacaaagaaagctgtaatggtttatattaccagggttcttgttatatattacattcagactaccagttattctcggatgctaaagcaaattgcactgcggaatcatcaacactacccaataaatccgatgtcttgattacctggctcattgattatgttgaggatacatggggatctgatggtaatccaattacaaaaactacatccgattatcaagattctgatgtatcacaagaagttagaaagtatttttgtgttaaaacaatgaactaa

SEQ ID NO: 720 - DNA, 1935 bp, Vaccinia virus
atggaagccgtggtcaatagcgatgtttttttaacatctaacgcaggactaaaatctagttatactaatcaaactctttctttggtagatgaagatcatattcacacttctgataaatctttgtcttgtagtgtatgcaattcattgtcccaaattgtagacgatgactttatatccgcaggggctagaaatcaacgtaccaaacctaaacgtgcaggaaataatcaatctcaacagcctatcaaaaaggattgtatggtttccatcgacgaagtagcatctacacatgattggagtacgagattgagaaatgatgggaatgcaattgctaaatatctaactactaacaagtatgacacatctaactttactattcaggatatgcttaacattatgaataaactaaatattgtcagaacaaatagaaacgagctatttcaactccttacccatgtaaagagcacattgaacaatgctagtgtttctgtgaaatgtactcatcctttagtacttattcattctcgagctagtcctagaatcggtgaccaactcaaagagttagataaaatatactctccatctaatcatcatattcttctgtcgactacacgattccaatccatgcattttaccgatatgtctagttcacaagatttgtcttttatttatagaaaaccagaaactaattactatattcatcctattctgatggcactattcggtattaaacttcctgcgctcgagaacgcgtatgtacatggagacacctatagcctaatccagcaactttatgaatttagaaaagtaaagtcttataattatatgttgttggttaatcgtcttacggaggataatccgatagtgattacaggtgtatcagatctaatttccacagagattcagagagcaaacatgcataccatgattagaaaagcaattatgaacattagaatgggaattttttattgtaacgatgatgatgcggtagatccccatctaatgaagattattcatactggatgctctcaagttatgacagatgaggaacagatattggcttctattttgtctatagttggatttagacctacgttggtttctgtggctagacctataaacggcatcagttacgatatgaaacttcaggcggcaccatacatagttgttaatcctatgaagatgatcacaacatccgacagtccgatttctatcaattccaaggatatttattctatggcattcgatggcaatagtggaagagtggtgttcgctcctcctaacataggatatggaagatgttctggagttacacacattgatccattgggaactaatgtgatgggtagtgctgttcattcccctgttatcgttaatggagcaatgatgttttatgtagaacgacgtcagaataagaatatgtttggtggagaatgttacaccggctttagatctctaatagatgatactccgattgacgtatcaccagaaatcatgctaaacggtatcatgtataggttaaagtccgcagtttgttacaaactcggagaccaattctttgattgtggatcgtctgatatcttcttgaagggacattatacgattctatttacagaaaatggaccctggatgtacgatcctctttctgttttcaatccgggagctagaaatgctagattgatgcgagctctcaaaaaccagtacaagaaattatcaatggattcagacgatggtttttatgaatggttgaatggcgacggttcagtatttgctgcctcaaaacagcaaatgttgatgaatcacgttgctaactttgacgacgatcttctaactatggaagaagccatgtcgatgatttcgagacattgttgtatcttaatttatgcacaggattatgatcaatatattagcgctagacatattacagaactattttag

SEQ ID NO: 721 - DNA, 660 bp, Vaccinia virus
atgtactcgttagtatttgttattttgatgtgtataccatttagttttcaaacagtgtatgatgataaatcggtatgcgattctgacaataaagaatatatgggaatagaagtttatgtagaagcaacgctagacgaacccctcagacaaacaacgtgtgaatccaaaatccataaatatggtgcatctgtatcaaacggaggattaaatatttctgttgatctattaaactgttttcttaattttcatacagttggtgtatacactaatcgcgataccgtatacgcgaagtttgctagtttggatccatggactacggaacctataaattctatgacccatgacgatctagtaaaattaacagaagaatgtatagtggacatttatttaaaatgtgaagtggataaaacaaaggatttcatgaaaactaacggtaatagattaaaaccaagagactttaaaactgttcctccttctaatgtaggaagcatgatagaactacagtctgactattgcgtaaacgatgtgactacatacgtcaaaatatacgatgagtgtggaaacattaaacagcattccattccaacactaagagattattttaccaccaagaatggtcaaccacgtaaaatattaaagaaaaaatttgataattgttaa

SEQ ID NO: 722 - DNA, 759 bp, Vaccinia virus
atgggtaacaaaaatattaaaccatctaaggaaaatagactgtccatcttgtccaaggataagatggattcatttaagagaggatcttgggcaacgtcatcctttagagaaaagtcgcgtgcaaccatccaaagattttcatctcttagacgagaacatattaaagtagaccatcctgacaagttcctggagttaaagagagggatatataaaataattcagaaatcgtcgtctatagatgtggacaaacggactaagctcatgtccaacataaaaacgatgatgataaatccattcatgatcgagggtttaatgacatctttagaaaacttggatcccgataacaagatgagctactcatcggtgatgatattgggagaattcgacatcatcaatataagcgacaatgaggcggcattcgagttcataaacagtctgttgaaatctcttctcttgttaaatactagacaactaaaactcttggaatactccattagtaatgacttgttgtatgcccacataaatgcgttggagtatatcataaaaaatacatttaatgttccagaacggcaactgattctgagaggtcaatacctaactccaattttcagtgatttgttaaagtatgcgggtctaaccataaagtcaaacatactcatgtggaataaacagtttatcaaaccagtatctgacctctatacatctatgagactccttcattgtgttacagaatcatataaggtgattggaatgggataa

SEQ ID NO: 723 - DNA, 846 bp, Vaccinia virus
atggacttctttaacaagttctcacaggggctggcagaatcctctacaccaaagtcgtcaatctattattctgaagaaaaggatccggatacgaaaaaggatgaagcgattgaaataggactaaagtctcaagagtcgtattatcaaagacagttgcgagaacaactagctagagataatatgacggtcgccagcagacagcctatccaaccgctacaaccaactattcatataactccacagccggttccaacagctacaccggctcctattcttctacctagtagtactgttcctacaccaaaaccacgacaacaaactaatacatcatctgatatgtctaatctttttgattggctgtctgaagatactgatgcgccggcgagttcactccttccagcgttgacgccgagcaatgctgttcaggatattatctctaaatttaataaagatcaaaagacgacgacaccgccatctacccaaccttctcagacgttaccaacaactacatgtacacaacaatcggatggaaatatttcttgtactactccaacggttacacctcctcaacctcctattgtggccactgtatgtactcctacacctactggtggtacagtatgtacaacagcacaacaaaatccaaatccaggagcagcatctcaacaaaatctagacgatatggcccttaaggatctcatgtcgaatgttgaaagagatatgcaccaacttcaggccgaaacaaacgatctggtgacgaacgtatatgatgcaagggagtatacgcgtagggcaatagatcaaattctacaactagtcaaaggttttgaacgattccaaaagtaa

SEQ ID NO: 724 - DNA, 945 bp, Vaccinia virus
atgacacgattaccaatacttttgttactaatatcattagtatacgctacaccttttcctcagacatctaaaaaaataggtgatgatgcaactctatcatgtaatcgaaataatacaaatgactacgttgttatgagtgcttggtataaggagcccaattccattattcttttagctgctaaaagcgacgtcttgtattttgataattataccaaggataaaatatcttacgactctccatacgatgatctagttacaactatcacaattaaatcattgactgctagagatgccggtacttatgtatgtgcattctttatgacatcaactacaaatgacactgataaagtagattatgaagaatactccacagagttgattgtaaatacagatagtgaatcgactatagacataatactatctggatctacacattcaccggaaactagttctaagaaacctgattatatagataattctaattgctcgtcggtattcgaaatcgcgactccggaaccaattactgataatgtagaagatcatacagacaccgtcacatacactagtgatagcattaatacagtaagtgcatcatctggagaatccacaacagacgagactccggaaccaattactgataaagaagatcatacagttacagacactgtctcatacactacagtaagtacatcatctggaattgtcactactaaatcaaccaccgatgatgcggatctttatgatacgtacaatgataatgatacagtaccaccaactactgtaggcggtagtacaacctctattagcaattataaaaccaaggactttgtagaaatatttggtattaccgcattaattatattgtcggccgtggcaattttctgtattacatattatatatataataaacgttcacgtaaatacaaaacagagaacaaagtctag

SEQ ID NO: 725 - DNA, 660 bp, Vaccinia virus
atggcgatgttttacgcacacgctctcggtgggtacgacgagaatcttcatgcctttcctggaatatcatcgactgttgccaatgatgtcaggaaatattctgttgtgtcagtttataataacaagtatgacattgtaaaagacaaatatatgtggtgttacagtcaggtgaacaagagatatattggagcactgctgcctatgtttgagtgcaatgaatatctacaaattggagatccgatccatgatcaagaaggaaatcaaatctctatcatcacatatcgccacaaaaactactatgctctaagcggaatcgggtacgagagtctagacttgtgtttggaaggagtagggattcatcatcacgtacttgaaacaggaaacgctgtatatggaaaagttcaacatgattattctactatcaaagagaaggccaaagaaatgaatgcacttagtccaggacctatcattgattaccacgtctggataggagattgtatctgtcaagttactgctgtggacgtacatggaaaggaaattatgagaatgagattcaaaaagggtgcggtgcttccgatcccaaatctggtaaaagttaaacttggggagaatgatacagaaaatctttcttctactatatcggcggcaccatcgaggtaa

SEQ ID NO: 726 - DNA, 954 bp, Vaccinia virus
atgaaaacgatttccgttgttacgttgttatgcgtactacctgctgttgtttattcaacatgtactgtacccactatgaataacgctaaattaacgtctaccgaaacatcgtttaatgataaacagaaagttacgtttacatgtgatcagggatatcattcttcggatccaaatgctgtctgcgaaacagataaatggaaatacgaaaatccatgcaaaaaaatgtgcacagtttctgattacatctctgaattatataataaaccgctatacgaagtgaattccaccatgacactaagttgcaacggcgaaacaaaatattttcgttgcgaagaaaaaaatggaaatacttcttggaatgatactgttacgtgtcctaatgcggaatgtcaacctcttcaattagaacacggatcgtgtcaaccagttaaagaaaaatactcatttggggaatatatgactatcaactgtgatgttggatatgaggttattggtgcttcgtacataagttgtacagctaattcttggaatgttattccatcatgtcaacaaaaatgtgatatgccgtctctatctaatggattaatttccggatctacattttctatcggtggcgttatacatcttagttgtaaaagtggttttacactaacggggtctccatcatccacatgtatcgacggtaaatggaatcccgtactcccaatatgtgtacgaactaacgaagaatttgatccagtggatgatggtcccgacgatgagacagatttgagcaaactctcgaaagacgttgtacaatatgaacaagaaatagaatcgttagaagcaacttatcatataatcatagtggcgttaacaattatgggcgtcatatttttaatctccgttatagtattagtttgttcctgtgacaaaaataatgaccaatataagttccataaattgctaccgtaa

SEQ ID NO: 727 - DNA, 747 bp, Vaccinia virus
atgaacttttacagatctagtataattagtcagattattaagtataatagacgactagctaagtctattatttgcgaggatgactctcaaattattacactcacggcattcgttaaccaatgcctatggtgtcataaacgagtatccgtgtccgctattttattaactactgataacaaaatattagtatgtaacagacgagatagttttctctattctgaaataattagaactagaaacatgtttagaaagaaacgattatttctgaattattccaattatttgaacaaacaggaaagaagtatactatcgtcatttttttctctagatccagctactgctgataatgatagaatagacgctatttatccgggtggcatacccaaaaggggtgagaatgttccagagtgtttatccagggaaattaaagaagaagttaatatagacaattcttttgtattcatagacactcggttttttattcatggcatcatagaagataccattattaataaattttttgaggtaatcttctttgtcggaagaatatctctaacgagtgatcaaatcattgatacatttaaaagtaatcatgaaatcaaggatctaatatttttagatccgaattcaggtaatggactccaatacgaaattgcaaaatatgctctagatactgcaaaactcaaatgttatggccatagaggatgttattacgaatcattaaaaaaattaactgaggatgattga

SEQ ID NO: 728 - DNA, 1896 bp, Vaccinia virus
atgagtaaatcacacgcggcctatatcgattatgcattgcgcagaactactaatatgcctgttgaaatgatggggtcggacgtagtacgcctcaaggattatcaacattttgtagcaagagttttcttaggattagacagtatgcattctcttttattgttccatgaaacgggtgtcggtaaaacaatgactactgtatatattctcaaacatcttaaggatatttatacgaattgggctattatcttattggtgaaaaaggctttgatagaagatccttggatgaacactatactcagatacgctccagagataacgaaggattgtatttttattaattacgatgatcaaaattttagaaataaattttttactaatatcaaaactattaattccaagagtagaatatgcgtcattattgatgaatgtcataacttcatttctaaatcattaatcaaagaagatggtaagatccgtcctactcgttcagtatataattttttatctaagaccatcgcattaaaaaaccataagatgatttgtttatcggctacacctatcgtcaatagtgtgcaagaattcaccatgttggttaacttactacgaccaggatccttacaacaccaatcgctatttgagaataaacgtctagttgatgaaaaagaattagtctccaaactaggaggcctatgttcgtacatagttaataacgagttttctatttttgatgacgtagaagggtctgcatcattcgctaagaaaacagtattaatgcgatacgttaatatgtcgaaaaagcaagaagaaatttatcaaaaggctaaactcgctgaaataaaaacaggtatatcatcatttagaattctgagacgtatggctactacgtttacgttcgatagctttcctgaaagacaaaatcgtgatccgggcgaatacgcgcaagagatagcaacactatataatgattttaaaaattcattaagagatagagaattttctaaatctgcattagatacctttaaaaggggagaactattgggaggggatgctagtgcggctgatatctctctatttactgaattaaaagagaaaagcgtcaaatttatagatgtatgtttgggaatattagcatcccatggtaaatgtctagtctttgaaccatttgttaatcagtcaggaatagaaatcttattactatatttcaaagtctttggtatctctaatatagagttctcatctagaacaaaagatactagaatcaaggcggtggctgagtttaaccaagaatcaaacactaacggagaatgcattaaaacatgcgtattctcttctagtggaggcgagggtattagcttcttctcaatcaatgatatcttcattttagatatgacatggaacgaggcgtctcttcgtcagatagtaggaagagccattcgtctcaatagtcacgttcttactcctccagaacgtagatatgtaaacgtgcactttataatggctagattatctaatggtatgcctactgtagacgaagacctatttgaaatcattcaaagcaaatcaaaagaatttgtccaattgtttagagtgtttaaacatacatcattagaatggattcatgctaatgaaaaagacttctcaccgatcgacaatgagtccggttggaaaaccttggtttcaagagccatcgatctatcgtctaacaaaaatattaccaataaactaattgagggtactaatatttggtattccaattctaatagattaatgtcaataaatagaggatttaaaggcgtagatggtcgagtatacgatgtagacggtaactatctacatgatatgccggacaatcccgttataaaaatacacgatggtaaattaatttatattttctaa

SEQ ID NO: 729 - DNA, 1656 bp, Vaccinia virus
atgaataatactatcattaattctttgatcggtggggatgactctattaaacggtctaatgtcttcgcagtcgatagtcaaattccaactttatatatgccgcaatatatttctctatccggagttatgacaaacgatggtccagacaatcaggctatcgctagcttcgaaattagggatcagtatattactgcgcttaatcatttggttctgagtttggaacttccagaagttaaaggtatgggaagattcggttacgtaccatatgttggatataaatgtattaatcacgtatctatctcttcgtgtaacggtgttatttgggaaattgagggcgaagaattatataataattgtatcaataatacaattgctttgaaacactctggatattctagtgaacttaatgatatttctattggcctaactcctaatgacactattaaagaaccatctacagtatacgtttatattaaaactccgtttgatgtggaagatacattcagcagtcttaaactatccgattcaaaaattaccgtaacggtaaccttcaatccagtatccgatatcgttattcgtgactcttcgttcgactttgaaacgttcaacaaagaatttgtttatgttcctgaattgagctttattggatatatggttaagaatgtacaaattaaaccatcatttatagagaaacctaggagagtaataggtcaaataaaccaaccaacggcgactgtaactgaagttcatgcggcaacatcgctctctgtttatactaaaccttattatggaaatacggataataaatttatttcgtatccagggtactcacaagatgaaaaagattatatagatgcatatgtgagtagattgttggatgatctagttattgttagcgatggtccaccgactggttatccggagtctgccgagatcgtagaggttccagaagatggtatcgtttctattcaagatgctgatgtgtatgtaaaaattgataatgttcctgataatatgagtgtttatcttcatactaatctgctaatgtttggaacacgaaaaaattcttttatatataacatttctaaaaagttttccgccattactggaacatatagtgatgccactaagagaacaatctttgctcacatatcacatagtatcaacatcatcgatacatctattcctgtaagtctttggactagtcaacgtaacgtctataacggagataatagatcagccgaatcaaaggccaaggatttgttcattaacgatcccttcatcaagggaatagattttaagaataagaccgatattatttctagactagaagttagatttggaaatgatgttctatattcagagaacggacccatctcgagaatttataatgaactactgacaaaaagcaataatggaacaagaaccctaacttttaactttacaccaaagatattctttaggccgacaactattacggctaatgtatctagggggaaagataaactatctgttcgagtagtttattccaccatggatgtcaaccatccaatctattatgtacaaaaacaattggtagttgtatgtaatgacctgtataaggtatcttacgatcaaggggtaagtattaccaagattatgggagataataactaa

SEQ ID NO: 730 - DNA, 915 bp, Vaccinia virus
atgccgcaacaactatctcctattaatatagaaactaaaaaagcaatttctaacgcgcgattgaagccgttagacatacattataatgagtcgaaaccaaccactatccagaacactggaaaactagtaaggattaattttaaaggaggatatataagtggagggtttctccccaatgaatatgtgttatcatcactacatatatattggggaaaggaagacgattatggatccaatcacttgatagatgtgtacaaatactctggagagattaatcttgttcattggaataagaaaaaatatagttcttatgaagaggcaaaaaaacacgatgatggacttatcattatttctatattcttacaagtattggatcataaaaatgtatattttcaaaagatagttaatcaattggattccattagatccgccaatacgtctgcaccgtttgattcagtattttatctagacaatttgctgcctagtaagttggattattttacatatctaggaacaactatcaaccactctgcagacgctgtatggataatttttccaacgccaataaacattcattctgatcaactatctaaattcagaacactattgtcgtcgtctaatcatgatggaaaaccgcattatataacagagaactatagaaatccgtataaattgaacgacgacacgcaagtatattattctggggagattatacgagcagcaactacctctccagcgcgcgagaactattttatgagatggttgtccgatttgagagagacatgtttttcatattatcaaaaatatatcgaagagaataaaacattcgcaattattgccatagtattcgtgtttatacttaccgctattctcttttttatgagtcgacgatattcgcgagaaaaacaaaactag

SEQ ID NO: 731 - DNA, 1440 bp, Vaccinia virus
atgaataggaatcctgatcagaatactcttcctaatattacattaaagattatagaaacctatttaggcagagtacctagtgtgaacgaatatcatatgttaaaattacaagctagaaatattcaaaaaataactgtttttaacaaagacatatttgtatctttagtaaaaaagaataaaaaaagatttttttccgatgttaatacatctgcatcagaaataaaagatcgtatacttagctacttttctaaacagactcaaacatataatataggtaaattatttacgattatagaactacaatctgtattagtgaccacatacacggacatattaggagttcttactattaaagctccaaatgtaatttcatctaaaatttcttataatgtaacatcaatggaagaattggcaagagatatgctaaattctatgaacgtcgcagtaatagacaaggcaaaagtaatgggacgtcataatgtatcttccctagtcaaaaatgttaataagttgatggaagaatatcttagacgccataataaaagttgtatatgttacggatcatattctctatatctaattaatccaaatatacggtacggcgatatagatattcttcagactaattctagaacttttcttatagatttggcctttctaataaaatttatcacgggaaataatattatattaagtaaaatcccatatcttagaaactatatggtgataaaagatgaaaacgataatcatatcattgatagttttaatattcgccaggataccatgaacgtagttcctaaaatctttatagataatatctatatagtggatccgacgtttcaactattgaacatgataaaaatgttttctcaaatagatagattggaagatctatccaaagatcctgaaaagtttaatgcgcgtatggcaaccatgctagaatacgttagatatacacatggtatagtctttgatggtaagcgtaataatatgccgatgaaatgtatcatcgatgaaaataatcgcatagttactgtcactactaaagactattttagctttaaaaaatgtctagtgtatctagatgaaaatgtgttatcgagtgatatattagatcttaacgccgacacatcgtgtgatttcgagagtgttacaaattctgtatatctaattcatgataatatcatgtatacatatttctcaaatactattctccttagtgataaggggaaggtacatgaaataagtgccagaggtttatgtgcacatatattgttgtatcagatgctgacatctggagaatacaaacaatgtttatcggatctcttaaattcgatgatgaatagagataaaatacctatctattcacatactgaaagagataaaaaacctggacgacacggatttattaatatcgaaaaggatataattgtattttag

SEQ ID NO: 732 - DNA, 573 bp, Vaccinia virus
atgtctaaaatctatatcgacgagcgttctaacgcagagattgtgtgtgaggctattaaaaccattggaatcgaaggagctactgctgcacaactaactagacaacttaatatggagaagcgagaagttaataaagctctgtacgatcttcaacgtagtgctatggtgtacagctccgacgatattcctcctcgttggtttatgacaacggaggcggataagccggatgctgatgctatggctgacgtcataatagatgatgtatcccgcgaaaaatcaatgagagaggatcataagtcttttgatgatgttattccggctaaaaaaattattgattggaaaggtgctaaccctgtcaccgttattaatgagtactgccaaattactaggagagattggtcttttcgtattgaatcagtggggcctagtaactctcctacattttatgcctgtgtagacatcgacggaagagtattcgataaggcagatggaaaatctaaacgagatgctaaaaataatgcagctaaattggcagtagataaacttcttggttacgtcatcattagattctga

SEQ ID NO: 733 - DNA, 1119 bp, Vaccinia virus
atgtggccatttgcatcggtacctgcgggagcaaaatgtaggctggtagaaacactaccagaaaatatggattttagatccgatcatttaacaacatttgaatgttttaacgaaattatcactctagctaagaaatatatatacatagcatctttttgttgtaatcctctgagtacgactaggggagcgcttatttttgataaactaaaagaggcatctgaaaaagggattaaaataatagttttgctagatgaacgagggaaaagaaatctgggagagctacaaagtcactgcccggatataaattttataaccgttaatatagataaaaaaaataatgtgggactactactcggttgtttttgggtgtcagatgatgaaagatgttatgtaggaaacgcgtcatttactggaggatctatacatacgattaaaacgttaggtgtatattctgattatcccccgctggccacagatcttcgtagaagatttgatacttttaaagcctttaatagcgcaaaaaattcatggttgaatttatgctctgcggcttgttgtttgccagttagcactgcgtatcatattaagaatcctataggtggagtgttctttactgattctccggaacacctattgggatattctagagatctagataccgatgtagttattgataaactcaagtcggctaagactagtatagatattgaacatttggccatagttcccactacacgtgtcgacggtaatagctactattggcccgacatttacaactccattatagaagcagccattaatagaggagttaagatcagacttctagttggtaattgggataagaacgacgtatattctatggcaaccgccagaagtctagacgcgttgtgtgttcaaaatgatctatctgtgaaggttttcactattcagaataatacaaaattgttgatagtcgacgacgaatatgttcatatcacttcggcaaatttcgacggaacccattaccaaaatcacggattcgtcagttttaatagtatagataaacagcttgtaagcgaggctaaaaaaatatttgagagagattgggtatctagccacagtaaatcgttaaaaatttaa

SEQ ID NO: 734 - DNA, 444 bp, Vaccinia virus
atgttcaacatgaatattaactcaccagttagatttgttaaggaaactaacagagctaaatctcctactaggcaatcaccttacgccgccggatatgatttatatagcgcttacgattatactatccctccaggagaacgacagttaattaagacagatattagtatgtccatgcctaagttctgctatggtagaatagctcctaggtctggtctgtccctaaaaggcattgatataggaggcggtgtaatagacgaagattataggggaaacataggagtcattcttattaataatggaaaatgtacgtttaatgtaaatactggagatagaatagctcagctaatctatcaacgtatatattatccagaactggaagaagtacaatctctagatagtacaaatagaggagatcaagggtttggatcaacaggacttagataa

SEQ ID NO: 735 - DNA, 639 bp, Vaccinia virus
atggcggaaactaaagagtttaaaactttgtataatctttttatagatagttatttacaaaaattagctcaacattctatccctactaatgtcacttgtgctattcatataggagaggttataggacagtttaaaaattgcgcgctccgaataactaacaaatgcatgagtaattctcgacttagtttcacactcatggttgaatcatttattgaagtgatttcattgcttccggaaaaggatagaagagctatcgctgaagaaataggaatagatctagacgatgtacctagtgcggtatccaagctagaaaagaactgtaatgcgtatgcggaggttaataatattatagatatacagaaattagatatcggagaatgttcggctccgcccggtcaacatatgcttttacagatagttaatacaggatccgcggaagcaaattgtggtttacagacaattgttaagtccttaaataaaatatacgttccacctattatcgaaaaccgattgccgtattacgatccgtggtttctagtgggtgtagcaattattctagttatttttactgtagctatttgttctattagacgaaatctggctcttaaatacagatacggaacgtttttatacgtttaa

SEQ ID NO: 736 - DNA, 1305 bp, Vaccinia virus
atgggtatcaaaaacttaaaatcgttactgctggaaaataaatcactgacgatattagatgataatttatacaaagtatacaatggaatatttgtggatacaatgagtatttatatagccgtcgccaattgtgtcagaaacttagaagagttaactacggtattcataaaatacgtaaacggatgggtaaaaaagggagggcatgtaaccctttttatcgatagaggaagtataaaaattaaacaagacgttagagacaagagacgtaaatattctaaattaaccaaggacagaaaaatgctagaattagaaaagtgtacatccgaaatacaaaatgttaccggatttatggaagaagaaataaaggcagaaatgcaattaaaaatcgataaactcacatttcaaatatatttatctgattctgataacataaaaatatcattgaatgagatactaacacatttcaacaataatgagaatgttacattattttattgtgatgaacgagacgcagaattcgttatgtgtctcgaggctaaaacacatttctctaccacaggagaatggccgttgataataagtaccgatcaggatactatgctatttgcatctgctgataatcatcctaagatgataaaaaacttaactcaactgtttaaatatgttccatctgcagaggataactatttagcaaaattaacggcgttagtgaatggatgtgatttctttcctggactctatggggcatctataacacccaacaacttaaacaaaatacaattgtttagtgattttacaatcgataatatagtcactagtttggcaattaaaaattattatagaaagactaactctaccgtagacgtgcgtaatattgttacgtttataaacgattacgctaatttagacgatgtctactcgtatattcctccttgtcaatgcactgttcaagaatttatattttccgcattagatgaaaaatggaatgaatttaaatcatcttatttagaaagcgtgccgttaccctgccaattaatgtatgcgttagaaccacgcaaggagattgatgtttcagaagttaaaactttatcatcttatatagatttcgaaaatactaaatcagatatcgatgttataaaatctatatcctcgatcttcggatattctaacgaaaactgtaacacgatagtattcggcatctataaggataatttactactgagtataaatagttcattttactttaacgatagtctgttaataaccaatactaaaagtgataatataataaatataggttactag

SEQ ID NO: 737 - DNA, 1116 bp, Vaccinia virus
atggctgcagaacagcgtcgttctacaatttttgacatagtttcaaaatgtatagtgcaatctgtattaagagatatatctattaattctgaatacatagagtccaaagctaaacaattgtgctattgtccggcatcgaaaaaggaatcggtgattaatggtatctacaattgttgcgagtcaaatatagaaataatggacaaagagcagctattaaaaatattggacaatcttcgatgtcattcggctcatgtatgtaacgccacagatttctggagactatataattcgttaaaacggtttactcatactaccgcattctttaatacatgcaagcccactattctagccacgctaaacactttgataaccctgattttatctaacaagttattgtatgcggcagaaatggtagagtatctagagaaccaactagattcatcaaataaatcaatgtctcaagaactagcagaattattggaaatgaaatatgctctcattaatctggtacaatataggattttgccaatgatcatcggtgagcctattatagtagctggattttctggtaaagaaccaatttctgattattctgcagaagtggaaaggctaatggaactaccagttaaaactgatatagtgaataccacatatgacttcttagccagaaaaggtattgatactagcaacaatatagcagaatatatagccggcttgaaaatagaagagattgaaaaggtagaaaaatatttaccagaagttatatctacaattgccaatagtaatataataaaaaataaaaaatctatctttccggccaatatcaacgataaacagatcatggaatgctctagaatgttagacacgagtgagaaatactctaaaggatataaaactgatggagctgtgactagtccattgacgggaaataatacaattacaacatttataccaatttctgcgtccgatatgcaaaagtttaccattttagaatatctttacattatgagagtgatggcaaacaacgttaagaaaaagaacgagggaaaaaacaacggaggagtagttatgcatattaactcaccctttaaggtaatcaatttgccaaaatgttaa

SEQ ID NO: 738 - DNA, 975 bp, Vaccinia virus
atggcggcggcgaaaactcctgttattgttgtgccagttattgatagacttccatcagaaacatttcctaatgttcatgagcatattaatgatcagaagttcgatgatgtaaaggacaacgaagttatgccagaaaaaagaaatgttgtggtagtcaaggatgatccagatcattacaaggattatgcgtttatacagtggactggaggaaacattagaaatgatgacaagtatactcacttcttttcagggttttgtaacactatgtgtacagaggaaacgaaaagaaatatcgctagacatttagccctatgggattctaatttttttaccgagttagaaaataaaaaggtagaatatgtagttattgtagaaaacgataacgttattgaggatattacgtttcttcgtcccgtcttgaaggcaatgcatgacaaaaaaatagatatcctacagatgagagaaattattacaggcaataaagttaaaaccgagcttgtaatggacaaaaatcatgccatattcacatatacaggagggtatgatgttagcttatcagcctatattattagagttactacggcgctgaacatcgtagatgaaattataaagtctggaggtctatcatcgggattttattttgaaatagccagaattgaaaacgaaatgaagatcaataggcagatactggataatgccgccaaatatgtagaacacgatccccgacttgttgcagaacaccgtttcgaaaacatgaaaccgaatttttggtctagaataggaacggcagctactaaacgttatccaggagttatgtacgcgtttactactccactgatttcattttttggattgtttgatattaatgttataggtttgattgtaattttgtttattatgtttatgctcatctttaacgttaaatctaaactgttatggttccttacaggaacattcgttaccgcatttatctaa

SEQ ID NO: 739 - DNA, 612 bp, Vaccinia virus
atggcgtggtcaattacaaataaagcggatactagtagcttcacaaagatggctgaaatcagagctcatctaaaaaatagcgctgaaaataaagataaaaacgaggatattttcccggaagatgtaataattccatctactaagcccaaaaccaaacgagccactactcctcgtaaaccagcggctactaaaagatcaaccaaaaaggaggaagtggaagaagaagtagttatagaggaatatcatcaaacaactgaaaaaaattctccatctcctggagtcagcgacattgtagaaagcgtggccgctgtagagctcgatgatagcgacggggatgatgaacctatggtacaagttgaagctggtaaagtaaatcatagtgctagaagcgatctctctgacctaaaggtggctaccgacaatatcgttaaagatcttaagaaaattattactagaatctctgcagtatcgacggttctagaggatgttcaagcagctggtatctctagacaatttacttctatgactaaagctattacaacactatctgatctagtcaccgagggaaaatctaaagttgttcgtaaaaaagttaaaacttgtaagaagtaa

SEQ ID NO: 740 - DNA, 945 bp, Vaccinia virus
atgcgtgcacttttttataaagatggtaaactctttaccgataataattttttaaatcctgtatcagacgataatccagcgtatgaggttttgcaacatgttaaaattcctactcatttaacagatgtagtagtatatgaacaaacgtgggaggaggcgttaactagattaatttttgtgggaagtgattcaaaaggacgtagacaatacttttacggaaaaatgcatgtacagaatcgcaacgctaaaagagatcgtatttttgttagagtatataacgttatgaaacgaattaattgttttataaacaaaaatataaagaaatcgtccacagattccaattatcagttggcggtttttatgttaatggaaactatgttttttattagatttggtaaaatgaaatatcttaaggagaatgaaacagtagggttattaacactaaaaaataaacacatagaaataagtcccgatgaaatagttatcaagtttgtaggaaaggacaaagtttcacatgaatttgttgttcataagtctaatagactatataagccgctattgaaactgacggatgattctagtcccgaagaatttctgttcaacaaactaagtgaacgaaaggtatatgaatgtatcaaacagtttggtattagaatcaaggatctccgaacgtatggagtcaattatacgtttttatataatttttggacaaatgtaaagtccatatctcctcttccatcaccaaaaaagttaatagcgttaactatcaaacaaactgctgaagtggtaggtcatactccatcaatttcaaaaagagcttatatggcaacgactattttagaaatggtaaaggataaaaattttttagatgtagtatctaaaactacgttcgatgaattcctatctatagtcgtagatcacgttaaatcatctacggatggatga

SEQ ID NO: 741 - DNA, 441 bp, Vaccinia virus
atggaaatggataagcgtatgaaatctctcgcaatgaccgctttctttggggagctaagcacattagatattatggcattgataatgtctatatttaaacgccatccaaacaataccattttttcagtggataaggatggtcagtttatgattgatttcgaatacgataattataaggcttctcaatatttggatctgaccctcactccgatatctggagatgaatgcaagactcacgcatcgagtatagccgaacaattggcgtgtgtggatattattaaagaggatattagcgaatatatcaaaactactccccgtcttaaacgatttataaaaaaataccgcaatagatcagatactcgcatcagtcgagatacagaaaagcttaaaatagctctagctaaaggcatagattacgaatatataaaagacgcttgttaa

SEQ ID NO: 742 - DNA, 939 bp, Vaccinia virus
atggcggaatttgaagatcaactcgttttcaatagtatcagtgcccgtgcattgaaagcttatttcactgctaaaatcaatgaaatggtagatgagttggtcacaagaaaatgtccacaaaagaaaaaatcacaagctaagaaacctgaagtacgcattcctgtagatcttgtaaagtctagttttgtgaaaaagtttggattgtgcaattatggaggaatccttatcagtcttattaatagtctagtagaaaataatttctttacaaaggatggaaaactggatgatacaggcaaaaaggaattggttttgacagatgtcgaaaaacgaattcttaataccatagataaatcatctcctttgtatatcgatattagtgatgttaaagtattggctgctagactaaaaagaagcgctacacaatttaactttaatggacatacatatcatctggaaaatgataaaatagaagatctcattaatcagttggttaaggacgaatccattcaactggatgaaaagagttctattaaagatagtatgtatgtcattcccgatgaacttatcgatgttctcaaaactagattgtttagatctcctcaagtcaaggataatattatttcgcgtactagattgtatgattattttactagagttactaagagagacgaatcgtcaatctatgtgattctaaaggatcctaggatcgctagcattttgtcactagaaactgttaaaatgggcgcctttatgtatacaaaacatagtatgttgacgaacgctatttcatctagagtcgatagatattctaaaaagtttcaagaatctttttacgaagatattgcagaatttgttaaagaaaatgagagagttaatgtatcgagagtggttgaatgtttgactgtgcctaatattactatatcaagtaatgctgaataa

SEQ ID NO: 743 - DNA, 1110 bp, Vaccinia virus
atgattgcgttattgatactatcgttaacgtgttcagtgtctacctatcgtctgcaaggatttaccaatgccggtatagtagcgtataaaaatattcaagatgataatattgtcttctcaccgtttggttattcgttttctatgtttatgtcgctattgcctgcatcaggtaatactagaatagaattattgaagactatggatttgagaaaaagagatctgggtccagcatttacagaattaatatcaggattagctaagctgaaaacatctaaatatacgtacactgatctaacttatcaaagtttcgtagataatactgtgtgcattaaaccgtcgtattatcaacaatatcatagattcggcctatatagattaaactttagacgagatgcggttaataaaattaattctatagtagaacgtagatccggtatgtctaatgtagtagattctaatatgctcgacaataatactctatgggcaatcattaatactatatattttaaaggtatatggcaatatccgtttgatatcactaaaacacgcaatgctagttttactaataagtacggtacgaaaacggttcccatgatgaacgtagttactaaattgcaaggaaatacaatcacaatcgatgacgaagaatatgatatggtacgccttccgtataaggatgctaatattagtatgtacctggcaataggtgataatatgacccatttcacagattctattacggctgcaaaattagactattggtcgtttcaattagggaataaagtgtacaatcttaaactccctaaattttctatcgaaaataagagggatattaagtcgatagccgaaatgatggctcctagtatgtttaatccagataatgcgtcgtttaaacatatgactagggacccattatatatttataaaatgtttcagaatgcaaagatagatgtcgacgaacaaggaactgtagcagaggcatctactattatggtagctacggcgagatcatctcctgaaaaactggaatttaatacaccatttgtgttcatcatcagacatgatattactggatttatattgtttatgggtaaggtggaatctccttaa

SEQ ID NO: 744 - DNA, 756 bp, Vaccinia virus
atgagtctactgctagaaaacctcatcgaagaagataccatattttttgcaggaagtatatctgagtatgatgatttacaaatggttattgccggcgcaaaatccaaatttccaagatctatgctttctatttttaatatagtacctagaacgatgtcaaaatatgagttggagttgattcataacgaaaatatcacaggagcaatgtttaccacaatgtataatataagaaacaatttgggtctaggagatgataaactaactattgaagccattgaaaactatttcttggatcctaacaatgaagttatgcctcttattattaataatacggatatgactgccgtcattcctaaaaaaagtggtaggagaaagaataagaacatggttatcttccgtcaaggatcatcacctatcttgtgtattttcgaaactcgtaaaaagattaatatttataaagaaaatatggaatccgcgtcgactgagtatacacctatcggagacaacaaggctttgatatctaaatatgcgggaattaatatcctaaatgtgtattctccttccacatccataagattgaatgccatttacggattcaccaataaaaataaactagagaaacttagtactaataaggaactagaatcgtatagttctagccctcttcaagaacccattaggttaaatgattttctgggactattggaatgtgttaaaaagaatattcctctaacagatattccgacaaaggattga

SEQ ID NO: 745 - DNA, 387 bp, Vaccinia virus
atggagaatgttcctaatgtatactttaatcctgtgtttatagagcccacgtttaaacattctttattaagtgtttataaacacagattaatagttttatttgaagtattcgttgtattcattctaatatatgtattttttagatctgaattaaatatgttcttcatgcctaaacgaaaaatacccgatcctattgatagattacgacgtgctaatctagcgtgtgaagacgataaattaatgatctatggattaccatggatgacaactcaaacatctgcgttatcaataaatagtaaaccgatagtgtataaagattgtgcaaagcttttgcgatcaataaatggatcacaaccagtatctcttaacgatgttcttcgcagatga

SEQ ID NO: 746 - DNA, 354 bp, Vaccinia virus
atgaggactctacttattagatatattctttggagaaatgacaacgatcaaacctattataatgatgattttaaaaagcttatgttgttggatgaattggtagatgacggcgatgtatgtacattgattaagaacatgagaatgacgctgtccgacggtccattgctagatagattgaatcaaccagttaataatatagaagacgctaagcgaatgatcgctattagtgccaaagtggctagagacattggtgaacgttcagaaattagatgggaagagtcattcaccatactctttaggatgattgaaacatattttgatgatctaatgattgatctatatggtgaaaaataa

SEQ ID NO: 747 - DNA, 327 bp, Vaccinia virus
atggccgaggaatttgtacaacaaaggttggccaataacaaagtgacaatttttgtcaagtatacatgtcctttttgtagaaatgcactggatattctaaataagtttagtttcaaaagaggagcgtatgaaattgtcgatattaaagaatttaaacccgaaaatgaattgcgtgactattttgaacaaattactggtggtagaactgttcctagaatcttttttgggaaaacttctattggtggatatagcgacctgttggaaatagacaacatggacgcattgggtgatattctatcatctattggggtattgagaacttgttga

SEQ ID NO: 748 - DNA, 2178 bp, Vaccinia virus
atggaggtcacgaaccttattgaaaaatgtaccaagcactccaaagatttcgccactgaggtaaaaaaactatggaacgatgagttgagttctgaatcaggtctctcaagaaaaacaagaaatgtaattcgtaatattcttcgtgatatcactaagtcattaactacagataagaaatcaaagtgtttccgtatactagaacgttcgacgattaacggagagcagattaaagatgtatataaaactatttttaataatggtgttgatgtggagtctagaatcaacactacaggaaagtatgttctatttacagttatgacttatgttgctgctgaactacgactcattaagtcagacgagatattcgctcttctatcaagattttttaacatgatatgtgatattcatagaaaatacggatgtggtaatatgtttgttggtattcccgctgctctaattattctgttggaaattgatcacatcaataaactgtttagcgtgtttagtacaagatatgatgctaaggcatatctatatactgaatatttcctcttccttaacattaatcattatctacttagtggttcagatttatttatcaacgtagcatatggtgctgtatctttttcgtcacccattagtgttccagattatatcatggaagcactgacatttaaggcatgtgatcatattatgaaatctggagatctaaaatatacatatgcgtttactaaaaaggttaaggatctgtttaatactaaatctgattctatttatcaatacgttagacttcatgaaatgtcatatgatggtgtttcagaagatacggatgatgacgatgaggtattcgctatccttaacttgagtattgattccagcgttgatagatacagaaacagagttcttctactaactcccgaagtcgcgtctcttagaaaagaatattcagacgtagaacccgattataaatacttgatggatgaggaagtgcccgcgtacgacaagcatttgcctaagcctattactaacactggtattgaagaaccacacgctactggaggagatgaggaccaaccaattaaggttgtccatccccctaataatgataaagatgatgctatcaagccatacaatccattagaagatcctaattatgttcccacaattacaagaacggctataggaatcgctgattaccaactagttattaataaactaattgaatggttagataaatgcgaggaagaatgcggaaatagtggagagtttaaaacagagttggaagaagccaagagaaaactcaccgaattgaatgcagaacttagtgataaactcagtaagattaggactttggaaagggattctgtttataaaaccgaaagaatcgaccgacttacaaaagagatcaaagaacacagggatattcaaaatgggacagatgatggttcagatttattagaaattgataagaagactatccgagaattgagagaatcgcttgatagggaacgagaaatgcgttcagaactagaaaaggaactggatactattaggaatggaaaagtagatggatcttgtcaacgagaacttgaactcagtcgtatgtggctaaaacaacgcgatgacgatctccgagctgaaatcgataaacgtcgtaatgtcgaatgggaactgtccagacttcgtagggatatcaaggaatgcgacaaatacaaggaggatcttgataaggccaagacaactattagtaactacgtaagcaaaatcagtactctagaatcagaaattgctaaatatcaacaagatagggacacgctttctgtagtacgcagagaacttgaggaagaacgacgacgcgttagagatctcgaatctagactcgatgaatgtacacgcaaccaggaagacacgcaagaagttgatgcactgcgttcgcgtattagagaactagagaataagttgaccgactgcatcgagagcggaggaggaaatcttacagagattagcagactccaatctaaaatctcagatcttgaaagacaactgagtgaatgccgtgaaaatgctacagagattagcagactccaatctagaatatcagatcttgaaagacagttgaacgactgtagacgtaataatgaaaccaatgccgaaacagagagagatgcgacgtcttag

SEQ ID NO: 749 - DNA, 438 bp, Tuberculosis
atgagtgagcaggtggaaacccggttgaccccacgcgagcggctgacccggggtctggcctactctgcggtgggtccggtggacgtgacccgaggcctcctcgaactcggggtcggacttgggcttcagtccgcccggtcgaccgcggccgggcttcgccgccgttaccgggaaggccgattggcccgcgaggtcgctgccgcccaagagacgctcgctcaagagctgaccgctgcccaggacgtggtggccaacctaccgcaggccctacaggacgcccggacccaacgtcgcagcaaacaccacctctggatcttcgcggggatcgcggcggccatcctcgccggcggtgccgtcgccttcagcatcgtccggcgctcgtcgcgaccggagccgtcgccccgaccaccgagcgtcgaggtgcaaccgcgctcctga

SEQ ID NO: 750 - DNA, 846 bp, Tuberculosis
gtgaattacagcgaggtcgagctgttgagtcgcgctcatcaactgttcgccggagacagtcggcgaccggggttggatgcgggcaccacaccctacggggatctgctgtctcgggctgccgacctgaatgtgggtgcgggccagcgccggtatcaactcgccgtggaccacagccgggcggccttgctgtctgctgcgcgaaccgatgccgcggccggggccgtcatcaccggcgctcaacgggatcgggcatgggcccggcggtcgaccggaaccgttctcgacgaggctcgctcggataccaccgttactgcggttatgccgatagcccagcgcgaagccatacgccgtcgtgtggcgcggctgcgcgcgcaacgagcccatgtgctgacggcgcgacgacgggcacgacggcacctggcggcgctgcgtgcgctgcggtaccgggtggcgcacggcccgggggtcgcgctggccaaacttcggctgccgtcgccgagcggtcgcgccggcatcgcggtccacgccgcgctgtcgcgacttggccgtccctatgtctggggcgcaacggggcccaaccagttcgactgttccggtttggtccagtgggcctacgcccaggcgggtgttcacctggatcgcaccacctatcaacagatcaacgaggggatcccggtgccgcgctcacaggtccggccgggcgatctggtcttcccgcaccccgggcacgtgcagctggcgatcggcaacaatctggtcgtcgaggcgccccatgcgggcgcgtcggttcgggtcagctcgctgggcaacaacgtgcagattcggcgaccgctgagtggcagataa

SEQ ID NO: 751 - DNA, 564 bp, Tuberculosis
gtgccgtcgttcgacgtcgtgttcgtcggccaccgccgcggggaggttcgcagcgacaacgccatgctgggtctgctgtgtgacgcggcattcgacgagctaacccggcccgatgtggtgatctttccgggcggcatcggaactcggaccctgatccacgaccagaccgtgctcgactgggtgcgcgaagcgcaccggcacaccctactcaccacctcggtgtgcaccggcgggctggtgttggcggctgccggactgctcaacggcttgaccgcgaccacgcattggcgagtacaggatctgttcaactcgctgggcgcccgatacgtcccccagcgtgtcgtcgagcatctgccagagcgggtcatcaccgccgccggggtgtcgagcgggatcgacatgggattgcggctggtggagcttttggtcagccgggaagccgccgaagcgagccagctgatgatcgagtatgacccgcagccaccggtggatgccggctccctggccaaggcctcgccggctacccatcggctcgcgttggagttctatcagcatcgtttgtga

SEQ ID NO: 752 - DNA, 426 bp, Tuberculosis
atgtgcgccgacgcccagccgtcagggagcgttgggctgctcggacggaattgccccaccgcaaccacccggtggcggcgggccggggaggggctcaccgccgctgacacaatcgaagtaaaactgtgggccggtaaaccacgtttgcatccactggtgccaaaacgagccgtcggggtacttctcgccgtcgcacacggccaagtcgccaaaaccccatcggccacccgggcaatagcctttcgtcatgtccggctgatgcgggtcaggtggatctgcgctggcaaccgaggcaggaaacacaagcgccgctgcacaacccagtatcgcagtactcaggcgagcaaacttcaacttcatttcaaactccgtcaaacgttgaatcgactcggcggactccaagcgatggtcagcgcttgcggatga

SEQ ID NO: 753 - DNA, 663 bp, Tuberculosis
atgagtaacgccaacttctcgatcctggtcgacttcgccgcgggtgggctggtgttggcgtcggtgctgattgtctggcgccgcgacctgcgggccattgtgcggctgctggcctggcagggtgctgcgctggccgcgatcccgctactgcgcggcatccgcgacaacgaccgtgcgctgatcgcggtgggcatcgccgtgttggcgctgcgcgcgctggtgttgccctggctgctggcccgcgcggtgggcgccgaagcggccgcgcagcgggaggccaccccgttggtcaacaccgccagctcgctgctgattaccgccggactgaccctcaccgcgttcgcgatcacccagccggtggtcaacctggaaccgggcgtcaccatcaacgcggtgccggccgcgttcgcggtggtgctgatcgcgctgttcgtgatgaccacgcggctgcacgcggtctcgcaggccgccggattcctgatgctagacaacgggatcgcggcgaccgcattcctgctcaccgccggggtgccgctgatcgtcgaacttggtgcctcgctggacgtgctgttcgcggtcatcgtgatcggcgtgttgaccggccggctgcgccgcattttcggcgatgccgacctggacaagctgcgggagttgcgggattga

SEQ ID NO: 754 - DNA, 1491 bp, Tuberculosis
atgtcgcttttgatcacatcaccggcgacggtggctgcggcggcaacacatctggcgggtatcggatcggcgctcagcacagccaacgcggcagcggccgctccgacgacggcgctatcggtcgcgggtgccgatgaggtctcggtgctgatcgcagcgctattcgaggcgtacgcccaggagtatcaggcgctgagtgcccaggcactggcgttccacgaccagttcgtgcaggcgctcaacatgggtgcggtttgctatgcggccgcagagacagccaacgcaactccgctgcaggctctgcagactgtgcagcagaacgtcctcaccgtggtcaacgcgcccacccaggcattgctaggtcgaccaatcatcggcaacggtgccaacgggttaccgaacaccgggcaagacggtgggcccggcgggttgctgttcggcaacggtggcaacggcggatccggcggggtggatcaggccggtggtaacggcggtgcagccggcctgatcggtaacggcgggtccggcggcgtcggcgggccggggatagctggcagtgcgggcggggcgggcggcgccggtgggctgctgttcggcaacggcgggcccggcggggccggtgggattggcaccaccggtgacggtgggcctggcggtgccggcggtaacgccatcggtctgtttggcagcggaggtaccggcgggatgggcggcgtcggcggcatgggcggtgtcggcaacggcggcaacgcgggtaacggcggcaccgccggactgttcggtcacggcggggccggcggtgccgggggcatcggcagcgccgacggcgggctcggtggtggcggcggcaatggccggttcatgggcaacggtggggtcggcggtgccggcggctacggcgctagcggagacggcggaaacgccggcaacggcggcttgggcggcgtgttcggcgatggcggggccggtggtaccggcggtctgggtgacgttaacggcgggcttgccggtattggcggtaacgccgggttcgtccgcaacggcggagccggcggcaatggccagctcggcagcggcgcagtctcctcggcgggtgggatgggcggcaacgggggcttggtgttcggcaacggcggccccggcggtctaggcgggccgggcacgtcggccggcaacggcggtatgggcggcaacgctgtcggactgttcggccagggcggggccggcggggccggcgggtccggattcggggccggtattccaggtggcaggggcggtgacggcggtagcggcgggctgatcggcgacggcggcaccggtggcggtgcaggcgcgggtgacgctgctgcatcggccggtggtaacggtggtaacgcccggttgatcgggaacggcggtgacggtggcccgggcatgttcggcgggcccggcggagctggcggcagcggcggcacgatattcggcttcgccggaacccccgggccgagctag

SEQ ID NO: 755 - DNA, 756 bp, Tuberculosis
atgcgtcgagtggttcgttatctatccgttgtggtcgcgatcacgctgatgctcaccgcggaatcagtcagcatagcgaccgccgcggtcccgccactccaaccgatcccaggcgttgcgtcggtgtcgccggctaatggtgccgtggtgggggtggcgcacccggtggtggtgacattcaccacgcccgtgaccgatcgccgcgccgtcgagcggtccatccgcatcagcacaccgcacaacacgaccggacacttcgagtgggtcgctagcaatgtcgtgcggtgggtgccccaccggtattggccacctcacacccgtgtctcggtgggtgtgcaggaactgaccgaaggattcgagaccggtgacgcactgatcggggttgccagcatctcggcacataccttcacggtcagcagaaacggagaagtcctccgcaccatgcccgcgtcgttaggcaagcccagccgcccgacaccaatcggtagctttcacgcaatgtccaaggagcgcacggtcgtgatggactcgcgtaccatcggcatcccgctgaattcctcggacgggtatctgctcaccgcccactacgcggttcgtgttacctggagcggcgtgtacgtgcactcggccccctggtcggtcaactcgcagggatacgccaacgtcagccacggctgtatcaacctcagcccggacaacgcggcatggtacttcgacgccgtcaccgttggtgatcccattgaggtggtcggctag

SEQ ID NO: 756 - DNA, 369 bp, Tuberculosis
atgacgaagaagccacgtaaccccgccgactacgtgatcggcgacgatgtcgaggtgtctgacgtcgatctcaagcaagaggaggtctatgtcgatggcgagcggctaacggacgagcgcgtcgagcagatggcttcagagtcgctgcggctggcgcgcgaacgagaagccaacctgattcctggcggcaagtctctgtccggcggctctgcgcactcgccggctgtgcaggtggtcgtttcgaaggctacccacgccaagctcaaggagctggcgcgcagccggaagatgagcgtatctaagctgctgcgtcccgtgctcgacgagttcgtacagcgagaaacgggtcggattctcccacggcgttag

SEQ ID NO: 757 - DNA, 870 bp, Tuberculosis
atgtcgaccgctgctgtgctgcgcgcccgcttcccgcgggcggtcgccaaccttcgtcaatatggaggtgcggcggcccgtggattggacgaggccggccagctcacctggttcgctttgaccagcatcgggcagatcgcgcacgcgctgcgctactaccgcaaggagacgctgcggctgatcgcccagatcggcatgggtaccggcgcgatggccgtcgtcggcggcacggtcgccatcgttggctttgtcacgctgtccggcagctcgctggtcgcaatccagggcttcgcgtcgctgggcaacatcggtgtcgaggcgttcaccgggttcttcgccgcactgatcaacgtgcgcatcgccggcccagttgtcacgggtgtcgccctggcggccacggtcggtgcgggtgctacggccgagctgggcgcgatgcggatcagcgaggagatcgatgccctggaagtgatgggcatcaagtcgatctcgtttctggcctccacccggatcatggccgggctggtggtgatcatcccgctgtacgcgttggcgatgattatgtcgttcctgtccccgcagatcaccaccacggtgctctacgggcagtcgaacggcacctacgagcattactttcaaacgttcctgcgtcccgacgatgtcttttggtccttcttggaggccctcatcatcactgcgatcgtcatggtcagccactgctactacgggtacgccgccggtggaggccccgtcggtgtcggcgaggccgtcggccgatcgatgcgtttctcgttggtctcggtgcaggtcgttgtcctgtttgcagcgttggcgctctacggtgtcgacccgaacttcaatctcacggtgtag

SEQ ID NO: 758 - DNA, 549 bp, Tuberculosis
atgttcgacattgcaacgcgtttcaaaaactcctacgggtcaggtccattgcacctgctggcgatggtgtctggcttcgccctgctgggctacatcgtggccaccgccaggccctcggcgctgtggaaccaggccacctggtggcagtcgatcgcggtctggtttgtcgccgccgtcgtagcccacgacctgctgttgtacccgctctacgcgctggccgaccggatcctggccaggctagtcggcaggcgcgacgtctcggcgccccgccgccgcccggaactaccggtacgcaactacattcggatcccggcgctggcagccggcttgacgctgctggttttcctgcccggcatcatcagacagggtgcgccgacatacctggatgcgaccggacagacgcaggaaccatttctgggcaggtggttgctgctcaccgcggtcgcgttcgggatcagcgcggccgcttacgccattcggctggtggtggcgcacgtgaggcggcgccgagcggggtgttcgcgggtcgacgcgatcgacgaggagtag

SEQ ID NO: 759 - DNA, 744 bp, Tuberculosis
atgaacctgatcttgacggcccacggaacccgcagaccgtccggtgtcgcgatgatagcggacatcgccgcgcaagtgagcgcgctcgtcgaccgcactgtgcaggtcgccttcgttgatgtgctcggaccctcacccagcgaagtgctttccgccctttcctgccgtcccgcaatcgtggtgcccgcgttcttgtcccgcggatatcatgttcgcaccgacctgcccgctcatgtcgcagccagtgcgcacccgcatgtcacggtcacccccgcgttggggccatgccgtgagatcgcgcagatagtcacccagcagctggtggaatccggttggcgtcctggcgattcagtgatcctcgcagcggccggcgcgtcggataggcgggcacgtgccgacctgcacaccactcggacgctagtgtccgaactgaccggatcatgggtggacatgggatttgcgggcaccggcggtccggatgtgcgcacggctgtgcagcgggcccgagaccgggccgaagccaaccgaggtgcgcgccgcgtcgcggtcgcctccttcctgttggcagaaggcctttttcaagagcggctgcgggcatccggtgccgatgtggtaacccgaccgctcggcacccatccgggcttggcacagctggtcgcgaaccgatttcgcagcgcggtagcacgtcagcaacggctgcaccgctggcatggcacgccgacaccggtgacgcttgatctttga

SEQ ID NO: 760 - DNA, 1776 bp, Tuberculosis
gtgtcctttgtgatcgcacaaccggagatgatcgcggcggcggccggtgagttggccagcatcagatcggcgatcaacgcggccaatgcggcggccgcggcccagaccaccggagtcatgtcggcggccgccgacgaggtgtctacggcggttgccgcgctgttttcctcgcatgcccaggcctatcaggccgccagcgcgcaagcggccgcctttcacgcccaggtggtgcggaccctgaccgtggacgcgggagcgtatgccagcgccgaggccgccaacgccgggccgaacatgctggccgcggtcaacgcccccgcccaggcgctgttggggcgcccactgatcggcaacggtgccaacggggcgccgggcaccgggcaggccggcggcgacggtgggctgttgttcggcaacggcggcaacggcgggtccggcgcacccggacaggccggcggggccggcggggcggccgggttcttcggcaacggtggcaacggcggggacggcggggccggagcgaacggcggcgccggcggcaccgccggctggttcttcggcttcggcggcaacggcggggccggcgggatcggtgttgccggcatcaacggcggtctcggcggcgccggcggcgacggcggcaacgccgggttcttcggcaacggcggcaacggcggcatgggcggggccggggcggccggcgtgaacgccgtcaatcccggcctggccaccccggtcaccccggcggccaacggcggcaacggcctcaacctcgtcggcgttcccggcaccgccggtggcggcgccgatggcgccaacggcagtgccattggccaggcgggcggcgctggcggtgacggcggcaacgcctccacgagtgggggcatcgggatcgcgcaaaccgggggcgccggcggcgctggcggtgccggcggcgacggcgcacccggtggcaacggcggcaatggtggcagcgtcgagcacactggcgctaccggctcctctgcgagcggcggcaatggtgccaccggcgggaacggcggggtcggtgcgcccggcggtgccggcggcaacggcggccacgtcagcggcggatcggtcaacacagccggcgccggtggcaaaggcggcaacggcggcaccggcggcgccggcggcccgggcggccacggcggcagcgttctatccggcccggttggcgacagtggcaacggtggtgccggcggggacggcggggccggggttagcgccaccgatatcgccggcaccggcgggcgcggcggcaacggtggtcatggcgggctgtggatcggcaacggcggcgacggtggtgcgggcggtgtcggcggtgtcggcggggccggtgcggctggcgcgatcggcggccacggcggcgatggcggctccgtaaatacccctattggcggcagcgaggccggtgacggcggtaagggcggcctgggcggggacggcggtgggcgcgggatattcggccagtttggggccggcggggccggtggtgccggaggcgtcggcggcgccggcggggctggcgggaccggcggcggcggcggcaacggtggggccattttcaatgccggtacccccggcgccgccggcacgggcggtgacggcggtgttggcgggaccggtgcggccggcgggaaaggcggggccggcggtagcggcggcgtcaacggcgccaccggcgccgacggcgccaagggcctcgacggtgccaccggcggcaaaggcaacaacggcaaccccggctga

SEQ ID NO: 761 - DNA, 627 bp, Tuberculosis
atgcgcctcacacatccggcccgacggtacctatccagtcaggctgcccggccaacaggcgcgttcggccgcctactgggacggatctggcgagccgagaccgccgacgtcaatcgcatcgccgtcgagctgctcgcgcccggcccgggcgagcgggtttgcgagatcggctttggccccggccgaacccttgggctgctcgccgccgccggcgcgcaagtgagcggcgtcgaggtgtcgacgaccatgatcgcaatcgcggcccatcacaacgcgaaagccattgcagccggcctgatctcgctttatcacggcgatggagtaaccctgccggttgccgaccacagccttgacaaggtgctcggcgtgcacaacttttacttctggcccgatccccgcgccagcctttgcgacatcgctcgagccctgcggcccgggggtcgactcgtccttacatcgatatccgatgaccaaccactggcggcccgtttcgatcccgcgatctatcgcgtgccccccaccctcgacaccgccgcgtggcttggcgctgccggcttcatcgacgtcggcatcaagcgcagtgcagaccatccggcgaccgtgtggttcaccgcaactgcgacgtga

SEQ ID NO: 762 - DNA, 2649 bp, Tuberculosis
gtgaccacgcaaacgctcatcaggctgatactgggcatgagcatgaccgcggtggtgggggtgttcgctctgcggcgagtctggtggctttacaagctggtcatgtccgggcagccggccagcgggcgaaccgacaacctcggcacccgcatctggacccagatctccgaggttctagggcagcgccgactgttgaaatggtcgatcccgggcctggcgcactttttcaccatgtggggcttcttcatcctgctcaccgtctatatcgaggcttacggcctgctgttcgaggagagattccacatcccggtcatcggccggtgggacgcgttgggcttcctgcaggacttctttgccaccgccgtctttctcggtatcacgaccttcgccatcatccgtatcctgcgcaacccccgcgagatcggtcggagctcccggttctacggatcgcacaacggcggcgcgtggctcgtcctgttgatgatcttcaacgtcatctggacctacgtgttggtccgcggctcagcggtcaacaacggcaccctgccctacggcaacggggccttcctatcgcagctattcggcgcgattcttcgccccctcgggcagcccgccaacgaaatcatcgaaaccacagcgctgttgctgcacatcggggtcatgcttgcgttcctgatcctcgttttgcattccaagcacctgcacatcttcctggcgcccattaacgtcacgttcaaacggctgccggatgggctgggcccgctgttgccgctcgaagccgatggcaaaccaatcgacttcgagaatcccagcgaggatgccgtattcggccgcggcaagatcgaagacttcacctggaaggggatgctcgacttcgctacctgcaccgagtgcggacgctgtcagtcgcaatgcccggcctggaacaccggcaaaccgttgtcgcccaagctggtcatcatggacctgcgcgaccattggatggccaaggcgccctacatcctgggccaaaaggatgccagcgcgggcggcgaggccggtcaccaagagcatcatcacgtgccggaatcggggttcggtcgagtgcccgggcatggaccggagcaggcgactcgcccgctggtcggcaccgaggaacagggtggcgttatcgatcccgacgtcttgtggtcatgtgtgacctgtggtgcctgcgtcgagcagtgcccggtggatatcgaacatgtcgatcacatcgtcgatatgcgccgctaccaggtgatgatggagtcggagttcccctccgagctgtcggtgctgttcaagaacctggagaccaagggcaacccgtggggtcagaacgcctcagatcgcaccaactggatcgacgaggttgacttcgacgtccccgtgtacggccaggacgtcgacagcttcgacggctacgagtacctgttctgggtgggttgtgcgggcgcctacgacgacaaggccaagaagaccaccaaggccgtcgccgagctgctcgccgtcgccagggtgaaatacttggtgctgggcgctggggaaacctgcaacggcgactcggcgcgccgctccggcaacgagttcctcttccagcagctggcacaacaggccgtcgagaccctggacggtttgttcgagggtgtggagaccgtcgaccgcaagatcgttgtcacctgcccgcactgcttcaacaccatcggcaaggaatatcggcagctgggcgccaactacaccgtgctgcaccacacccagctgctcaatcggttggtgcgcgacaagaggctggtccctgtcactccggtttctcaggacatcacctaccacgacccgtgctacctgggtcggcacaacaaggcctacgaggcaccacgggagctgatcggtgccgcgggggccagcctgaccgagatgccgcgccatgccgaccgcagcttttgttgcggcgcaggcggcgcccgcatgtggatggaagaacacatcggcaagcggatcaaccatgaacgcgtcgatgaggcgctggccaccgatgccaccgcaatcgccaccgcgtgcccattctgccgggtgatggtcaccgacggtgtgaacgatcggcaggaagaagccggccgcagcggcgtcgaggtgctcgacgtggcccaggtgctactcggatcactagaccacgacaaggcgcagctgccggccaagggtacggccgccaaacaggctcaggagcgcgccccgaaagccgctcctaaggctgccgcaccggtgacgcccgtggaggcacccgccgaggcaccacaggcgccagcgccggccgctcccgcagcacccgtgaaaggcctcggcatggccgccggcgccaagcggcctggcgccaagaaagcggccccaacgcccgcggccccggctgcgcccgccgcgcccgttaaagggctgggtattgccgccggcgccaagcggcccggggcgaaaaagacacctcccccggctcctgggctcgccgagccagcagcccagccgcaacccgaagcaaagccgcaaccggagcccgccgcaccgccaaagccgcaaaccgacggtgatccggctgcaccggccgcgccggtgaaagggctgggcattgcgcgcggggcccgtccaccgggcaaacgctga

SEQ ID NO: 763 - DNA, 561 bp, Tuberculosis
gtgcggctatcgctcattgcacggggtatggcggccctgctggcggctaccgcgctagttgccggctgcaacaccaccatcgacggcaggccggtcgcttcgccagggtcgggacctaccgagccgacttttccgacgcctaggccaactaccgcgccgccggggaccaccgccccgacgctaccgacgacaccggtcagcccgaccgcgccggccggcgccattccgctcccgcctgactccaacggttacgtcttcatcgaaaccaagtccggaatgacgcgttgccagatcaatagggacagcgttggctgcgaggcaccgttcaccaactcccccttgcgagatggtgagcacgccaacggcatccacatcaccgccggcggctccgtgcagtgggtgttgggcaatctgggcgccatccccaccgtcagcatcgactaccgaacctatgaggcgcagggctggaccatcgacgccaccaccgatggcacccgcttcacgaacaaccgcacgggccatggcatgttcgtcagcatcgagaaggtcgacacattctga

SEQ ID NO: 764 - DNA, 966 bp, Tuberculosis
atgaccccggctcaacttcgggcctattcggcggtggttcgcctgggctcggtacgggcggccgccgcggaactcggtctttccgacgccggagtctccatgcacgtcgcggcgctgcgcaaggaactcgacgacccgctgtttaccaggaccggtgccgggctggcgttcacgcccggcgggctgcggctggccagccgcgcggtcgaaatcctgggcctgcaacaacaaaccgcgatcgaggtcaccgaggccgcccacgggcgtcggttgctgcgcatcgccgcctccagcgccttcgccgaacacgccgcgccgggcctgatcgagctcttctcgtctcgggccgacgacctttcggtcgagttgagcgtgcatcccaccagccggttccgcgaactgatctgctcgcgcgccgtcgacatcgcgatcggcccggccagtgagagctcgatcggttccgacggctcgatctttctacggcccttcctgaagtatcagatcatcaccgtcgtcgcgccgaatagcccactggccgcaggcattccgatgcccgcgctgttgcgtcaccagcaatggatgttgggtccgtccgccggcagcgtagatggtgagatcgcaaccatgttgcgcggcttggcgattccggagtcccagcaacggatcttccagagcgatgccgccgcgctggaggaggtcatgcgcgtcgggggcgccacgctggccattggctttgcggtcgccaaggatcttgccgccggacggttggtgcacgtgaccggtcctgggctggatcgcgccggcgagtggtgtgtggcgacattggcgccttcggcccgccaacccgccgtctccgagcttgttggcttcatcagcaccccgaggtgtattcaggcgatgatcccgggtagcggggtcggggtgacgcggttccgcccaaaggtccacgtcaccctgtggagctag

SEQ ID NO: 765 - DNA, 1173 bp, Tuberculosis
gtgggcctcgaggaccgggacgcgttgcgggtgttgcaaaacgccttcaagctcgacgacccggaactggtccgccgcttctatgcccattggtttgccctcgacgcctcggtacgcgacctgttcccacccgacatgggcgcccagcgagccgctttcgggcaggcgctgcactgggtgtacggcgagctggtggcgcagcgcgccgaggaaccggtggcctttcttgcccagctcggccgcgaccaccgcaaatacggtgtgctgccaacccagtacgacacgttgcgccgcgcgctgtatacgaccctgcgtgactatctgggccatccaagccggggcgcctggacggacgccgtcgacgaggccgccggccagtcgctcaacctgatcatcggggtgatgagcggtgccgcggacgccgatgacgcgcccgcctggtgggacggcacggtcgtcgagcacatccgggtgtcacgcgaccttgctgtcgctcggctgcagctggaccgcccgctgcactattaccctggccaatacgtcaacgtgcatgttccgcaatgcccccgccggtggcgatatctcagcccagccattccggccgacccgaacgggcggatcgagtttcacgtccgggtggttcccggtggcctggtcagcaacgccatcgtgggtgaaactcggcccggtgaccggtggcgattgtccggtccgcacggagcctttcgggtggaccgcgacggcggcgacgtgctcatggtcgccggtagcaccgggctggcgccgctgcgggcgctgatcatcgacctcagccgcttcgcggtgaatccgcgcgtgcacctgttcttcggagcacgctatgcctgcgaactctacgacctgcccacgctgtggcagatcgcggcgcacaatccgtggctgtcggtctcgccggtgtcggagtacaacggtgatccggcttgggccgccgactatcccgacgtgtcggcgccgcgcggtctgcacgtgcgccagaccggccgactacccgatgtggtctcccgatacggcggctggggcgatcggcagattctgatctgcggtggaccggccatggtccgcgccaccaaggccgccctgatcgccaaaggcgcgccaccggagcgcattcagcacgacccactgtcgcgctag

SEQ ID NO: 766 - DNA, 543 bp, Tuberculosis
atggatttcggtgcgctaccaccggaaatcaactccgccagaatctattccggtcccggctccaggcccctgatgcaagcggccgcagcctggcaacggctggccaacgaactgaccgcgacggcggcttcctactcctcggtgatttccgggctcaccggcgatgactggctgggcccgtcggcactgtcgatggcggccgcggccgtcccctatgtcgcgtggatgagggccaccgccgcctcggccgagcaggccgcggctcaggccgtggccgcggcgaacgcctacgagtcggcgtacgcggcgaccgtgcccccgacggtaatcgcggccaaccgccgcacaatgctgtcactggtccagaccaatgtttttggacagaacaccccggcgatcgcgactagtgaaacgcactacggcgaaatgtgggcccatgacatcttggcgatggacggctatgcgggcgcctcgggggccgcgtcccagttgcgccgttcacccgccaccggcgaccaccagcggggccgggtcgctgagtga

SEQ ID NO: 767 - DNA, 369 bp, Tuberculosis
ttgctggccaccttctggggctggcgcgcccagcaactgcccgacggcaccgtgatttggacgctgccgggtgaccagacctatgtcaccaccccgggcagcgcgctgctgttcccggcgctgtgcacccccaccggtgacccacctcgacccgacccggcccgcgccgaccgccgcgggcagcgcaccgcgatgatgccgcgccgggccagcacccgagcgcaaaaccgcgcccactacatcgccgccgaacgccaccgcaaccaccaagcccgccggattgcccacgtggtcacccaaaccgccacaaccgcccccgagactaacggcccaccacccgatcccgacgacgacccgccgcccttctaa

SEQ ID NO: 768 - DNA, 798 bp, Tuberculosis
atgacgccgccgcgggtgttgagcatcgccggatcggactccgggggcggtgccggcatccaagccgatatgcgcacgatggcactgctaggagtgcacgcgtgcgtcgcagtcacggcggttaccgtacagaacacgttgggagtcaaggatattcatgaagttcccaacgatgtggtggccggccagatcgaggcggtcgtcaccgacatcggcgttcaagccgccaagaccgggatgctggcctcgtcgcgcatcgttgcgaccgtggccgcgacctggcgtcggctcgagctgtccgttccgctcgtcgtcgacccggtatgcgcatccatgcacggagacccgctgttggcaccgtctgccctggattcgcttcgcggtcagctgttcccgttggcgacgctgctgacccccaaccttgacgaggcgcgcctgctggtagatatcgaggtagtcgacgccgagtcgcagcgtgcggcggccaaagccctgcatgcgctggggccgcagtgggtgctggtcaaaggcggacacctgcgctcgtcggacggcagctgcgacctgctctatgacggcgtcagctgctaccagttcgacgcgcagcgactacccaccggcgatgaccatggcggtggtgacacgctggcgaccgcgatcgccgccgcgttggcgcacggcttcaccgtgcccgacgcggtggacttcgggaagcgatgggttaccgaatgcctgcgcgcggcctatccactgggccgcggccacgggcccgtttcgccgctgtttcggctgtcatga

SEQ ID NO: 769 - DNA, 861 bp, Tuberculosis
atgatcggaaagccccgcggcaggcgaggggtaaacctgcagatactgcccagcgcgatgacggtgctgtccatttgcgcgggactgaccgcaatcaagtttgcgctcgagcaccagccgaaggccgcgatggcactgatcgccgcagcggccatcctcgacgggctcgacggccgggtggcccgcatcctggatgcccagtcgcggatgggcgcagagatcgactcactggccgacgcggtgaacttcggagtgacacccgcgctggtgctttacgtgtcgatgttgtcgaagtggccggtcggttgggtggtcgtgctgctctacgcggtgtgcgtggtattacggctggcgcggtacaacgcactgcaggacgacggaacccagcccgcctacgcgcatgaattcttcgtcggaatgcccgcgccggcgggcgcggtttccatgatcggcctgctagccctcaaaatgcagttcggcgaaggatggtggacctcgggctggttcctcagcttttgggtgacgggaacgtcgatactcttggtcagcgggatcccgatgaaaaagatgcacgccgtgtcggtaccacccaactacgcggccgccctgctggcggtgctggctatctgcgcggcggccgcagtcctggccccctacttgttgatctgggtgatcatcatcgcctacatgtgccatattcctttcgcggtgcgcagccagcgctggcttgcccaacaccctgaggtgtgggacgacaagcccaagcaacggcgcgcggtgcggcgcgcgagccgccgggcgcatccctaccggccgtcgatggcgcggctgggcctgcgcaagccgggtcgacggctgtga

SEQ ID NO: 770 - DNA, 423 bp, Tuberculosis
atgtcgtcggaggagaagctggccgccaaggtgtccaccaaggcctccgatgtggcttccgacatcggcagcttcatcaggtcgcaacgtgagacggcgcacgtctcgatgcggcagctcgccgagcggtccggcgtcagcaatccgtacctgagccaggttgagcgcggattgcgtaagccgtccgccgacgtgttgagccagatcgcaaaggcgctgcgggtctcggccgaagtcctttatgtgcgcgccgggattctcgagcccagcgagaccagtcaggtgcgtgacgccatcatcaccgatacggcgatcaccgagcgtcagaagcagattctgctcgatatctacgcgtcatttacccaccagaacgaagccacccgggaggagtgtccgagcgatccgacaccgaccgatgactag

SEQ ID NO: 771 - DNA, 843 bp, Tuberculosis
atgcgaatcgcgttggcgcaaatccgcagcggtaccgaccccgccgccaatctgcaactggtcggcaagtacgccggcgaagccgccaccgcgggcgcacagctggtggtgtttcctgaggcgaccatgtgccggctcggtgtcccgctgcggcaggtcgccgagcccgtcgacggaccctgggcaaacggagtccgacggatcgcgaccgaggcgggcatcaccgtgatcgccggcatgttcaccccgaccggcgacgggcgggtaacaaacacgctgatcgcagccggcccgggcacgcccaatcagccggacgcgcactaccacaagatccacctctatgacgcgttcggcttcaccgagtcacgtaccgtcgcacccgggcgcgaaccggtggtagtcgtggtcgacggcgtgcgggtgggtttgaccgtttgctacgacattcgctttcccgccctttataccgagctggcgcggcgcggggcccaactgatcgcggtctgtgcatcctggggttccggtccgggcaaactcgaacagtggacgttgctggcccgcgcccgggcgctagactccatgagttacgtcgccgcggccggccaagcagacccaggtgatgcccgcaccggcgtgggggcgagctcggctgcaccgaccggggtaggcggcagcctggtggcctcgccgctaggcgaggtggtggtgtcagctggcacccagccgcaactgctggtcgccgacatcgatgtcgacaatgtggccgcggctcgcgaccgcattgcggtgctacgcaaccagacagacttcgttcagatcgataaggcacaatcgcgtgggtga

SEQ ID NO: 772 - DNA, 756 bp, Tuberculosis
atgacgacaatcggcacccgcaagcgagtcgccgtggtcaccggcgccagttccggtatcggcgaggcaaccgcgagaacccttgcggcccaggggtttcacgtggtcgcggtggcgcgtcgggcggaccggatcaccgcgctggccaaccagatcggcggaaccgcaattgtggccgatgtcactgacgacgccgccgtcgaagcgttggcccgcgcgctgagccgggtggacgtgctggtcaacaacgccggtggcgccaaggggcttcagttcgtcgccgatgccgatttggagcactggcgatggatgtgggacaccaacgtactgggcacgctgcgggtaacccgcgcgctgctgcccaagctgatcgactccggcgacggcctgatcgtcaccgtcacctcgatcgccgcgatcgaggtgtacgacggcggcgccggctacaccgctgccaagcacgcgcagggcgcgctgcatcgcacgctgcgcggcgaactgctggggaagccggtccggctcaccgagatcgctccaggtgcggtcgagaccgaattttcgctggtccgcttcgacggcgaccagcaacgcgcggacgcggtttatgccggcatgacaccgctagtagccgccgacgtcgccgaggtgatcggattcgtggccacccggccctcacacgtcaaccttgaccagatcgtcatccggccccgcgaccaggcatcagctagccgtcgcgctacccacccggtccgttag

SEQ ID NO: 773 - DNA, 1647 bp, Tuberculosis
atggacgtcgctttgggggttgcggtcacggatcgggtcgcgcgtctggcgctggtcgactcggctgcgcccggcaccgtgatcgaccagttcgtgctcgatgtggccgagcacccggtcgaggtgttaaccgagaccgtggtgggcacggatcggtcattggccggcgaaaaccaccggctggtcgctacccggctgtgttggccggatcaggccaaagctgacgagctgcagcacgcactgcaggactccggggtccacgacgttgccgtgatatccgaggcgcaggccgccacggcgctggtcggggcggcacatgccggctctgccgtgctgttggtgggtgatgagacggcaaccttatcggtggttggtgacccggacgcgccgccgacgatggtggccgtcgcgccggtggcgggcgccgacgccacatcgaccgtcgataccctgatggcccggctcggcgaccaggccctcgccccgggggatgtcttcctggtgggtaggtccgccgagcacaccacggttcttgccgaccagctgcgcgcggcgtcgacgatgcgcgtgcagactcccgacgaccccacgttcgcgctggcccgtggcgcggcgatggcggccggcgccgctacgatggcgcacccggccctggtcgcggatgcgaccacttcgctcccccgggccgaggcggggcaatcgggttctgaaggcgagcagctggcgtactcgcaggccagcgattacgagctgcttccggtcgacgaatatgaggaacacgacgaatacggggcagccgcggatcgctcggcgccgttgagccgacggtcgctgctgatcggcaacgctgtcgtggcctttgcggtgatcggtttcgcctcgctggcggtggcggtggcggtcaccatccgaccgaccgcggcctcaaaaccggtagagggacaccaaaacgcccagccagggaagttcatgccgttgttgccgacgcaacagcaggcgccggtcccgccgcctccgcccgatgatcccaccgctggattccagggcggcaccattccggctgtacagaacgtggtgccgcggccgggtacctcacccggggtgggtgggacgccggcttcgcctgcgccggaagcgccggccgtgcccggtgttgtgcctgccccggtgccaatcccggtcccgatcatcattcccccgttcccgggttggcagcctggaatgccgaccatccccaccgcaccgccgacgacgccggtgaccacgtcggcgacgacgccgccgaccacgccgccgaccacgccggtgaccacgccgccaacgacgccgccgaccacgccggtgaccacgccgccaacgacgccgccgaccacgccggtgaccacgccaccaacgaccgtcgccccgacgaccgtcgccccgacgacggtcgctccgaccaccgtcgccccgaccacggtcgctccagccaccgccacgccgacgaccgtcgctccgcagccgacgcagcagcccacgcaacaaccaacccaacagatgccaacccagcagcagaccgtggccccgcagacggtggcgccggctccgcagccgccgtccggtggccgcaacggcagcggcgggggcgacttattcggcgggttctga

SEQ ID NO: 774 - DNA, 633 bp, Tuberculosis
gtgctgccctgtctcaacgaggaggagtcactcccggcggtgctggccgcgatcccggccggctatcgggcgctagtggtggacaacaacagcaccgatgacaccgcgacggtggccgcccgccacggtgcccaggtggttgtcgagccgcggcccggatacggctcggcggtgcatgccggtgtgctcgccgcgaccacccccatcgtagcggtcatcgacgccgacggctcgatggatgccggcgacttgcccaagctggtcgccgaactcgacaagggcgccgacctggtgaccggtcggcggcggccggtggcgggcctgcactggccatgggtcgcccgggtgggcaccgtggtgatgagctggcggctgcgcacccgccaccgcctgccggtgcacgacatcgcgcccatgcgggtcgcccggcgagaggccctgctggatctgggcgttgtcgatcgacgctcgggttacccgctggagctgctggtccgggccgctgcggcgggctggcgtgtcgtcgaactcgacgtcagttacggtccccggaccggcggcaaatccaaggtcagcggttcgctgcggggcagcatcatcgcgatcctggacttctggaaggtgatctcgtga

SEQ ID NO: 775 - DNA, 414 bp, Tuberculosis
gtgagagcatcgcccacttcgccgccggagcaggtggtcgtcgacgcgagtgccatggtggatctactggctcgcactagcgatcggtgctctgcggtgcgcgcgcggctggctcggaccgcgatgcacgcgccggcgcacttcgatgcagaggtgttgtcggcgctggggcgcatgcagcgcgccggcgcactcaccgttgcctatgtcgatgcggcactggaggagttgcgacaggtgccggtgactcgacacggtctttcgtcgctgcttgctggagcgtggtcgcgccgcgacaccctccgcctgaccgatgccctctacgtcgagctggccgaaacggcaggtctggtgttgttgaccaccgacgaaagattggcacgcgcctggccctcggctcacgccatcggctga

SEQ ID NO: 776 - DNA, 267 bp, Tuberculosis
ttgttgagccggcgcacgaaaacgatcgttgtgtgtacattggtgtgtatggctcggttgaacgtgtatgtgcccgacgaattggcggagcgcgccagggcgcggggcttgaacgtctcggcgctgactcaggccgcgatcagtgccgagttggagaactccgcaaccgatgcgtggcttgaggggttggaacccagaagcaccggcgctcggcatgatgacgtgctgggtgcgatcgatgccgctcgcgatgagttcgaagcgtga

SEQ ID NO: 777 - DNA, 981 bp, Tuberculosis
gtgatacccgtgctgccccccctagaagccctgctggaccgcctgtatgtggtggccctgccgatgcgagtgcgtttccgcggcatcaccacccgtgaagtggccttgatcgagggtccggccggttggggcgaattcggtgcgttcgtggagtaccagtccgcgcaggcgtgcgcgtggttggcgtcggcgatcgagaccgcctactgtgcgccgccgccggtgcgacgtgaccgcgttccgattaacgccactgtgccggccgttgccgccgcccaggtgggcgaggtgctggcccggtttcctggggcccggacggccaaggtgaaggtcgccgagcctgggcagagcttggccgacgacatcgagcgtgtcaacgcggttcgggagctggttcccatggtgcgggtggacgccaacggtggctggggtgtcgccgaggcggtggccgcggcggccgccctgaccgccgacggcccgctggaataccttgaacaaccctgtgccaccgtcgccgaactcgccgagttgcgccggcgggtggatgtgccgatcgccgccgacgaaagcatccgcaaggccgaggatccgttggccgttgtccgcgctcaggccgccgatatcgcggtgctgaaggtcgccccgctgggcggtatttcggcgctgcttgatatcgcggcgcggatcgccgttccggtggtggtctccagcgcgctcgattccgccgtcggaatcgccgccggcctgaccgccgccgcggccctgccggagctcgaccacgcgtgcgggctgggcaccggcgggctgtttgaagaggacgtggccgagcccgcagcacccgtcgacggctttctggcagttgcgcggacaacgcccgacccggcgcggttgcaagccctgggtgcaccgccgcagcggcgacagtggtggatcgaccgggtcaaggcctgctactcgttgcttgtaccgtctttcgggtga

SEQ ID NO: 778 - DNA, 726 bp, Tuberculosis
atgtcaactgtgttgacatatatcagggccgttgatatatatgaacacatgactgaatcgctggatcttgagttcgaatccgcctaccgcggtgaatccgtcgccttcggggagggagtccgaccgccatggagcatcggcgaaccccagcccgagctggccgccctgatcgtgcagggcaagttccgcggcgacgtcctcgacgtgggctgcggggaggccgcgatttcgctggcactggccgaacggggacacaccacggtcggactggacctctcccccgccgccgtagaactggctcggcatgaagcagcgaagcgcggcctggccaatgccagcttcgaggtggccgacgccagttcgtttaccggctatgacggcaggttcgacaccatcgtcgacagcacgctgttccactccatgccggtcgagtcccgggagggctatctgcaatcgatcgtgcgtgcggcggcaccgggcgcctcctacttcgtgttggtattcgaccgggcggcgatacccgaggggccgatcaatgcggtcaccgaggacgagctgcgcgcggcggtgtccaagtactggatcatcgatgagatcaagcccgcgcggctgtacgcgaggttcccggccggcttcgccggcatgcccgcactcctggacatccgcgaagagcccaacgggctgcagtcgatcggtggctggctgctctcggcccacctgggctga

SEQ ID NO: 779 - DNA, 687 bp, Tuberculosis
atgaagcacttcacggcggccgtcgcgacggtggcgctgagcctggcactggctggctgcagtttcaacatcaagaccgacagcgcgccaaccacgtcgccaaccacgacgtccccgacgacgtcgacaacgactacgtcggcaaccacctcggctcaggcagcggggcccaactacaccatcgccgactatatccgggacaaccacatccaggagaccccagtgcaccacggcgaccccggctccccgaccatcgacctgccggtgcccgacgattggcggctgcttccggaaagctcccgcgcaccctatggcggcatcgtctacacccagcccgccgatcccaacgatccccccaccatcgttgcgatcctctccaaactcaccggtgacatcgaccccgcgaaggtcctccaattcgcacccggcgagttgaaaaacctgcccggcttccaaggcagcggcgacggaagtgcagccacgctcggcggcttttcagcatggcagctcggtggttcatacagcaagaacggcaagttgcggaccgtcgcgcagaagacggtggtgattcccagccaaggtgcggtgttcgtgcttcaactcaacgccgacgcgctcgacgacgagacgatgacgttgatggacgccgccaacgtcatcgacgagcagacgaccatcacgccctaa

SEQ ID NO: 780 - DNA, 723 bp, Tuberculosis
atggcgctgcagccggtgactcgccgatcggtgcccgaagaggtcttcgagcagatcgctaccgatgtgctcaccggcgagatgccgcccggcgaggcgttgcccagcgagcgtcggttggctgagttgctcggagtgtcgcgacccgcggtccgcgaggcgctcaaacggctgtcggccgcaggtctggtcgaggtgcgtcagggcgacgtcaccaccgtgcgtgacttccggcggcacgccggcctggatctgttgccccgattgttgtttcgcaacggtgagctggatatctccgtcgtccgcagcatcctcgaggcccggctgcgcaattttccgaaggtcgcggaactagcggccgaacggaacgagcccgagttggcggaattgctgcaggattcgctgcgtgcgctggacactgaggaagatccgatcgtgtggcaacgccacacgctcgacttttgggatcatgtggtcgacagcgccggttcgatcgtagatcgattgatgtacaacgcatttcgtgctgcttacgagccgacgctagctgctctgaccaccacgatgaccgctgcggctaagcgtccgtcggactaccggaaactcgcggatgcgatctgctcaggtgatcccaccggagcgaagaaagccgcccaagacctactcgaacttgcgaacacatcgttgatggccgtactcgttagccaggcgagtcggcaatga

SEQ ID NO: 781 - DNA, 255 bp, Tuberculosis
ttgctgcacagcagcttcgggcacctcgagggcatccagcagccgctcatagacgagctggcagaactcgaccacgtgttgggcaagctgccggacgcctaccggatcatcggccgcgccggcggcatatacggtgacttcttcaacttctatctgtgtgacatctcactgaaagtcaacggattacagcctggaggtccggtacgcaccgtcaagttgttcggccagccgaccggcaggtgcacaccgcaatga

SEQ ID NO: 782 - DNA, 243 bp, Tuberculosis
gtgatggacgtattggctgctgggatcgcggctggcgcgctcacgctggcggcgtggggcgcctggcgcccgcactaccgggcggcgtcctacctcgtggccggtgccgtagagctggcactgatcgggctgctggtggtgaccgggcaaacattgatggccatctcggtggccttccttgtggcgctgggcggtccgttggtggtggtcaaccaccgcagagctgaacgcagccgaggttag

SEQ ID NO: 783 - DNA, 717 bp, Tuberculosis
gtgactaccttcgacggtgacacgtccgcgggtgaggcggtcgatctaacagaggccaacgccttccaggatgcagcggccccggctgaagaggtcgatccggccgccgcgctcaaagcggagctgcgcagcaagcccggcgactggtacgtcgttcactcctacgcagggtacgagaacaaggtcaaggccaacctggaaacccgggtgcagaaccttgatgtcggcgactacatcttccaggtggaggtgcccaccgaagaggtcaccgagatcaaaaacggccaacgcaagcaggtcaaccgtaaggtgctgcccggctacattctggtgcggatggacttgaccgacgactcctgggccgcggtgcgtaacacgccgggggtcacggggttcgttggggcaacatctcgcccgtcagcgctcgccctcgacgacgtggtgaagtttctgcttccgcgggggtcgacgaggaaggctgccaagggtgcggccagcacggctgccgccgccgaggcgggcgggctagagcgtccggtcgtcgaggtcgactacgaggtgggcgaatcggtaaccgtcatggacgggccgtttgccacattgccggccacgatcagcgaggtcaacgccgaacagcagaaactcaaggtgctggtctccatcttcggccgcgaaacaccggtggagctgacctttggccaagtctccaagatctag

SEQ ID NO: 784 - DNA, 861 bp, Tuberculosis
atggccaagctgagaccatattacgaagagtcacagtcggcttacgacatttcggatgacttcttcgcgttgttcctcgatcccacctgggtctacacctgcgcctatttcgagcgtgacgatatgacgctggaagaggcgcaactggccaaggtggatctggcgttggacaagctgaacctcgaaccggggatgacgctactcgacgtgggttgcgggtggggcggggcgctcgttcgggccgtggagaagtacgacgtcaatgtcatcggcctcacgctcagccggaatcactatgaacgcagcaaagaccgcctggccgcaatcggaacgcaacggcgcgccgaggcccggctgcagggctgggaagagtttgaagagaacgtcgaccggatcgtcagctttgaggcattcgacgcgttcaaaaaggagcggtatctgacgttcttcgaacgctcctacgacatcctgcccgatgacgggcggatgctactgcacagcctgttcacctacgaccgcaggtggctgcacgaacagggcattgcgctgacgatgagcgaccttcgattcctcaaattcctgcgggagtcgatcttcccgggcggcgagctgccatcggagcccgacattgtcgacaatgcgcaggccgcgggcttcaccatcgagcatgtccagctgctgcagcagcactacgcacggactctcgatgcatgggccgccaacctacaggctgcccgcgaacgcgccatcgccgtacagtccgaagaggtctacaacaacttcatgcactatctgaccggatgcgcggagcgcttccgcagaggcctaatcaacgtcgcccagttcaccatgaccaagtag

SEQ ID NO: 785 - DNA, 843 bp, Tuberculosis
atgctccgcagggtcgccatactgctcgccgctgtgcttgcgttcgcgggctgctcggggggaacgaggttggcggcgggcttcggcaatggcaatagcgtgcacaccctcgatgtcgatggagccggccgcagctaccggctttataagcccgtcgggttgccgtcctcggcgccgctggtcgtcatgttgcacggcgggttcggcagcgccaagcaagccgaaaggtcttatggctgggacgaattggccgactccgagaagttcctcgtcgcctaccccgatggctatcacagggcttggaatgccaatggcggaggctgctgcggccggcccgcacgtgaaggcgtcgacgacatcggcttcgtccgcgcggtcgtcgccgacatcgccaacaatgtcagcatcgaccccgcccgggtctacgtcacgggcatgagcaacggtgccatcatgtcctacacgctggcctgcaacaccagcatcttcgcggcgatcggcgtcgtttcgggcacgcaactagacccctgtcagtccccgcgtccggtgtcggtcatccacatccatggcacggccgatccgctggtccgctaccacggcgggcccggcgccgggttcgcgcgcatcgacggtccgccggtgcccgatctcaatgcgttctggcgcgaggtcaaccggtgcggcgcgctggataccacgaccgaaggtccggtcaccacatcgggcgccacatgcgccgacaatcgccgtgtcgtgctgctcaccgtcgatgacgccggccaccgatggccgtcatttgccacccagacactgtggcgattctttgcagcgcacttcagatga

SEQ ID NO: 786 - DNA, 657 bp, Tuberculosis
atgaacttcgttgacgccccggaatccgcggtgctggcggccgccaaggacatgttgcgtcggggcctggtcgaggggaccgccggaaatatctcagccaggcgctcggacggcaacgtggtcatcacgccgtcctcggtcgactacgccgagatgctgctccacgatctggtgctagtcgacgccggcggtgcggtgctgcacgccaaggacggccggtcgccgtcgaccgaactaaacctacacctggcgtgctatcgcgcattcgacgacattggcagcgtgatccacagccacccggtgtgggcgaccatgttcgccgtcgcccatgagccgattcccgcctgcatcgacgagttcgcgatctactgcggcggggacgttcgctgcaccgagtacgccgcgtccggtacacccgaggtcggccgcaacgcggtgcgcgcgcttgagggccgcgccgccgccctgatcgccaaccacggcctggtggccgtggggccccgccccgaccaggtgctgcgcgtcaccgcccttgttgagcgcaccgcacaaatcgtttggggtgcccgcgctctcggtggaccggtgccaattcctgaggacgtgtgccgtaacttcacgggcgtctacggctatctgcgcgcgaatccgctctag

SEQ ID NO: 787 - DNA, 546 bp, Tuberculosis
gtgagagttttgttgctgggaccgcccggggcgggcaaggggacgcaggcggtgaagctggccgagaagctcgggatcccgcagatctccaccggcgaactcttccggcgcaacatcgaagagggcaccaagctcggcgtggaagccaaacgctacttggatgccggtgacttggtgccgtccgacttgaccaatgaactcgtcgacgaccggctgaacaatccggacgcggccaacggattcatcttggatggctatccacgctcggtcgagcaggccaaggcgcttcacgagatgctcgaacgccgggggaccgacatcgacgcggtgctggagtttcgtgtgtccgaggaggtgttgttggagcgactcaaggggcgtggccgcgccgacgacaccgacgacgtcatcctcaaccggatgaaggtctaccgcgacgagaccgcgccgctgctggagtactaccgcgaccaattgaagaccgtcgacgccgtcggcaccatggacgaggtgttcgcccgtgcgttgcgggctctgggaaagtag

SEQ ID NO: 788 - DNA, 801 bp, Tuberculosis
atgcgcccactggcacggctgcggggtcgcagggtcgtgccgcagcgcagtgccggcgaactcgacgcgatggccgcggcgggcgccgtcgttgccgccgcgctgcgggcgatccgtgcggcagcggctcccggcacatccagcctgagtctcgacgagatcgccgagtcggtgatccgcgaatccggcgccaccccgtcgtttctgggctatcacggctacccggcctcgatctgcgcgtcgatcaacgaccgggtggttcatggcatcccgtcgaccgccgaggtgctcgcgcccggtgatctggtatccatcgactgcggtgcggtgctggacggttggcatggcgatgcggcgatcactttcggggttggcgccctgagcgacgccgacgaagcgctgtcggaggcgacaagggaatcgcttcaggccggcatcgccgcgatggtggtcggcaatcggttgaccgacgtcgcgcatgccatcgaaacgggtacccgtgccgccgagctccgttatggacgctcgttcgggatcgtcgccggttacgggggccacggcatcggccgccagatgcatatggatccgttcttgccgaacgagggtgcgccggggcgcggtccgctgctggctgccggctcggtgctggccatcgaaccgatgctgaccctcggtaccaccaaaacggtggtgctcgacgacaaatggacggtcacgaccgccgatgggtcacgtgcggcacactgggaacacaccgtggcggtaaccgacgacgggccccgaattctgacgctcggttag

SEQ ID NO: 789 - DNA, 753 bp, Tuberculosis
atgacgatgccgctacgaggacttggcccgcccgatgacaccggtgtgcgcgaggtgtcgacgggtgatgatcaccactacgcgatgtgggatgcagcttacgtgttgggagcattgtctgcggccgaccgccgcgaattcgaagcgcacctggccggttgccccgaatgccggggggccgtcaccgaactctgcggggtgcccgccctgctgtcccagctcgatcgtgacgaagtggccgcgattagcgaatccgccccgactgtggtggcttcggggctgtcgccggagttgttgccgtcgttgctggcggcggtgcacaggcgtcggcgccgtacccggctgatcacctgggtggcctcgtccgccgctgccgcggtgctggcgatcggtgtgctagtcggtgtgcagggccactccgcggcaccgcagcgggcggccgtgtcggcgctgccgatggcccaggtcggcacgcagctgttggcgtccacggtgtcgatcagcggcgagccttgggggacgttcatcaacctgcggtgcgtctgcctggcgccgccgtatgcttcccacgacacgctggccatggttgtggtgggtcgtgacggcagccagacacggctggcgacttggttggccgaacccggtcacaccgcgacacccgccggcagcatttcgacaccggttgaccagatcgccgccgtgcaagtggttgccgccgataccggccaggttctgctgcagcgttcgctctaa

SEQ ID NO: 790 - DNA, 549 bp, Tuberculosis
gtggacccactgatggctcaccagcgcgctcaggacgcgttcgccgcgctcctggccaacgtccgcgctgaccagctcggcggccccacgccctgctcggagtggacgatcaacgatctgatcgagcacgtcgtcggcggcaacgagcaggtcgggcgatgggcggccagccccatcgagccacccgcccggcccgatggcctcgttgccgcccaccaagccgcggccgcggtcgcccacgagatcttcgcggcgccgggcgggatgtccgccacattcaagctgccgttgggcgaggttcccgggcaggtgttcatcgggttacgcaccaccgatgtgctgacccacgcgtgggatcttgccgccgccaccggccaatccaccgatcttgatcccgagttggccgtcgagcggctcgccgccgcgcgtgccttggtggggccgcagttccgcgggccgggaaagcccttcgcggacgagaagccttgcccgcgtgagcgcccgcccgccgatcagctggcggcatttttgggccgcacggtgcggtga

SEQ ID NO: 791 - DNA, 528 bp, Tuberculosis
atatcgtttgtgatcgcggcgccggaggccatcgcggcagcggccacggatttggcaagcatcggttcgacgatcggggcggccaacgccgcggccgcggccaacacgacggcggtgctggccgcgggcgccgatcaggtgtcggtggccatcgcggcggcttttggggcgcacggccaggcctatcaggcgctcagcgcgcaggcggcgacgtttcatatccagtttgtgcaggccttgaccgcgggcgcgggctcgtatgcggccgccgaggccgccagcgccgcgtccataaccagtccgctgctcgacgcgatcaacgcgcccttcctggcggcgttggggcgcccgctgatcggtaacggcgccgacggggcgccggggaccggggccgccggcggggccggcggattgttgttcggcaacggcggcgcgggcgggtccggcgcgcccggcggggccggcggattgttgttcggcaacggcggcgccggcggccccggcgcgtccggcggcgcgctgggctga

SEQ ID NO: 792 - DNA, 747 bp, Tuberculosis
atgttcgacagcaaggtggctatcgtcaccggggctgcccagggtatcgggcaggcctacgctcaggcgttggcccgcgaaggtgcctcggtggtcgtcgctgacatcaacgccgacggtgccgcggcggtagccaagcagattgtcgccgacggcggtactgcgattcatgtgcccgttgacgtgtccgacgaggattccgctaaagccatggtcgaccgcgccgtcggtgctttcggcggcatcgactatctggtgaacaatgcggcgatctacggtggcatgaagctcgatctgttgttgaccgtgccgttggactactacaagaaattcatgagcgtcaaccacgacggcgtgctggtgtgtacccgcgcggtgtacaagcacatggccaaacggggcggcggcgcgattgtcaaccagtcctcgaccgcggcctggctgtattccaacttctacggcctggccaaggtcggtgtcaacgggctgacgcagcagctggcccgcgagctgggcggaatgaagataaggatcaatgcgatcgcacccggaccgatcgacaccgaagctacccgcaccgtcacccccgcagagctggtcaagaacatggtgcagaccatcccgctgtcgcggatgggtacaccggaggatctggtgggcatgtgcctgttcctgctgtcggattcggcatcgtggatcaccgggcagatcttcaatgtcgatggcggacagatcatccggtcatga

SEQ ID NO: 793 - DNA, 306 bp, Tuberculosis
atgacgtcacccgtcgcggtcatcgcccggttcatgccacggcctgacgctaggtcggccctgcgcgctctcttggacgcaatgattaccccgacacgggccgaggacggatgccgtagctacgacctctacgagagcgccgacggcggcgagctggtgcttttcgaacggtaccgcagccgcatcgcgctcgacgagcaccgcggttcgccgcactatctgaactaccgggcacaggtcggtgaattgctgacccggcccgtcgcggtgactgtgctcgcgccgctcgacgaggcttctgcttag

SEQ ID NO: 794 - DNA, 834 bp, Tuberculosis
atggcacgctgcgatgtcctggtctccgccgactgggctgagagcaatctgcacgcgccgaaggtcgttttcgtcgaagtggacgaggacaccagtgcatatgaccgtgaccatattgccggcgcgatcaagttggactggcgcaccgacctgcaggatccggtcaaacgtgacttcgtcgacgcccagcaattctccaagctgctgtccgagcgtggcatcgccaacgaggacacggtgatcctgtacggcggcaacaacaattggttcgccgcctacgcgtactggtatttcaagctctacggccatgagaaggtcaagttgctcgacggcggccgcaagaagtgggagctcgacggacgcccgctgtccagcgacccggtcagccggccggtgacctcctacaccgcctccccgccggataacacgattcgggcattccgcgacgaggtcctggcggccatcaacgtcaagaacctcatcgacgtgcgctctcccgacgagttctccggcaagatcctggcccccgcgcacctgccgcaggaacaaagccagcggcccggacacattcctggtgccatcaacgtgccgtggagcagggccgccaacgaggacggcaccttcaagtccgatgaggagttggccaagctttacgccgacgccggcctagacaacagcaaggaaacgattgcctactgccgaatcggggaacggtcctcgcacacctggttcgtgttgcgggaattactcggacaccaaaacgtcaagaactacgacggcagttggacagaatacggctccctggtgggcgccccgatcgagttgggaagctga

SEQ ID NO: 795 - DNA, 423 bp, Tuberculosis
atgccggcaggcatggcaggttttcgacgatgggcccaaaccaatgatccgaccgcccacgccgagagccttgccatccgtgccgcgtgcaccaagctgggcactgagcacctggtcggtaccactctcaacgtgctggcccatccgtgtccgatgtgctatggatcgctgtactactgctcacccgatgaggttgtcttcctgacgtcgcgtgacgcctatgaaccgcattacgtcgatgaccgcaggtacttcgagcccgccaccttctacgacgagttcgccaaggaatggcaggaccggcgcctgccgatgcgccaagagcaccggcccgatatcagggctggcgcggtggatgtctaccggttccggcaggaacccaacggcggtgagcgcagcgcgatcgccgctccgacgggctga

SEQ ID NO: 796 - DNA, 861 bp, Tuberculosis
gtggaggggacaatcgcggtcccgggtggacgcgtctggttccagcggattggtggcggtcctggtcgtccgctgcttgtagtgcacggtgggccgggcttgccgcacaactacttggccccactgcgacggttgtctgatgagcgggaggtcatcttctgggaccagctcggttgcggaaattccgcatgtccgtcagacgtagacctttggacgatgaaccgctcagtggccgagatggcaaccgtggcggaagcccttgcccttacccgctttcacatcttcagccattcgtggggtgggatgctggcacagcagtacgtgctcgacaaggcgcctgacgccgtcagtctgaccatcgcgaacagcacggcttcgatacccgaattttcggccagtctggtcagcttgaagtcgtgcttggacgtggcaactcgctcggcaattgaccgtcacgaggcggccggcaccacccattccgccgaataccaggccgcgatcagaacctggaacgagacttatctgtgccgcacccgcccctggccccgggaactcacggaagcattcgccaacatgggaaccgagatcttcgagacgatgtttgggcccagcgactttcgcatcgttgggaatgttcgagactgggacgtcgtcgaccggttggccgacatcgcggtgccgaccttgctggtggtgggccgtttcgacgaatgttcgcctgagcacatgcgagaaatgcagggccggattgcgggctcgcgattggaattcttcgagtccagttcccacatgccgttcatcgaagagccggcgcgattcgaccgggtgatgcgtgaattccttcggctgcacgatatttga

SEQ ID NO: 797 - DNA, 867 bp, Tuberculosis
gtgaccgaaggccgttgtgcccagcaccccgacggcctcgatgttcaggacgtctgcgatcccgacgacccacggctcgacgatttccgtgacctgaacagcatcgaccgtcgtcccgatctgccgaccggcaaggcgttggtgatcgccgagggtgtgctggtggtgcagcgcatgctggcctcacggttcacgccgctggcgctgttcggcaccgaccgccggctggccgagctcaaggatgatctggccggtgtcggcgcgccgtactatcgagcgtcggctgatgtcatggcacgggtgatcggcttccatctcaatcgtggggtgttggcagccgcgggccgggtgccggagccgagcgttgctcaggtggtcgccggggcgcgcaccgtcgcagtgttggaaggcgttaacgaccatgagaacctgggctcgatcttccgcaacgcggcagggctgagcgtggacgcggtagtgttcggcaccggctgcgctgatccgctctaccgtcgtgcggtccgggtatccatgggacacgcgttattggtgccatatgcacgcgcggccgactggcccaccgaacttatgacgttgaaagagagcggctttcgactgttggcgatgaccccacacggcaacgcgtgcaaactaccggaggccatcgccgcggtgtcgcacgaacggattgcgctactggtgggcgcggagggcccgggcctaacggcggccgcactgcggattagcgatgtgcgggtgcgcattccgatgtcccgagggaccgactccctcaacgtcgcgacggcggccgcattggctttctacgagcggactaggtcgggccatcacattgggcccggcacgtga

SEQ ID NO: 798 - DNA, 1125 bp, Tuberculosis
gtgaaaattcgtttgcatacgctgttggccgtgttgaccgctgcgccgctgctgctagcagcggcgggctgtggctcgaaaccaccgagcggttcgcctgaaacgggcgccggcgccggtactgtcgcgactacccccgcgtcgtcgccggtgacgttggcggagaccggtagcacgctgctctacccgctgttcaacctgtggggtccggcctttcacgagaggtatccgaacgtcacgatcaccgctcagggcaccggttctggtgccgggatcgcgcaggccgccgccgggacggtcaacattggggcctccgacgcctatctgtcggaaggtgatatggccgcgcacaaggggctgatgaacatcgcgctagccatctccgctcagcaggtcaactacaacctgcccggagtgagcgagcacctcaagctgaacggaaaagtcctggcggccatgtaccagggcaccatcaaaacctgggacgacccgcagatcgctgcgctcaaccccggcgtgaacctgcccggcaccgcggtagttccgctgcaccgctccgacgggtccggtgacaccttcttgttcacccagtacctgtccaagcaagatcccgagggctggggcaagtcgcccggcttcggcaccaccgtcgacttcccggcggtgccgggtgcgctgggtgagaacggcaacggcggcatggtgaccggttgcgccgagacaccgggctgcgtggcctatatcggcatcagcttcctcgaccaggccagtcaacggggactcggcgaggcccaactaggcaatagctctggcaatttcttgttgcccgacgcgcaaagcattcaggccgcggcggctggcttcgcatcgaaaaccccggcgaaccaggcgatttcgatgatcgacgggcccgccccggacggctacccgatcatcaactacgagtacgccatcgtcaacaaccggcaaaaggacgccgccaccgcgcagaccttgcaggcatttctgcactgggcgatcaccgacggcaacaaggcctcgttcctcgaccaggttcatttccagccgctgccgcccgcggtggtgaagttgtctgacgcgttgatcgcgacgatttccagctag

SEQ ID NO: 799 - DNA, 849 bp, Tuberculosis
atgcactacggacttgtgctgttcaccagcgaccgcggcatcaccccggccgcggccgccagacttgctgaaagccacgggtttcgcacgttttacgtgcccgaacacacccacatcccggtcaagcgccaggcggcccatccgacgacgggtgacgcttcgctgccggacgaccgctatatgcgcacgttggacccgtgggtgagcctgggagcagcatcggcggtgacgtcgcggatccggcttgccaccgcggtggcgctgccggtcgagcatgatccgatcacgctggcgaaaagcattgcgacgctggatcatttgtcgcacggccgggtcagcgtcggggtcgggttcggctggaacaccgacgagctcgtcgatcatggtgtgccacccggacgccgccgcaccatgctgcgcgaatacctcgaggcgatgcgggcgttgtggacccaagaggaggcctgctatgacggcgagttcgtcaagttcggacctagctgggcctggcccaagccggtgcagccgcacatcccggtgctggtaggcgctgcggggacggagaagaacttcaagtggatcgcgcgcagcgccgacggctggatcaccactccacgcgacgtcgacatcgacgagccggtgaagttactgcaagacatctgggcggccgccggccgcgacgggcttccacagatcgtggccctggacgtcaaaccggtgcccgacaagctggcgcgctgggccgagcttggcgttacggaggtgctgttcggtatgccggacaggtctgcagacgacgcagccgcgtacgtggagcggctggccgccaagttggcctgttgcgtatag

SEQ ID NO: 800 - DNA, 732 bp, Tuberculosis
gtgtcgccgagacgctggttgcgggcggtcgccgtgataggggcgaccgcgatgctgttggcgtcgagctgcacttggcagctgagccttttcatcaccgacggcgtgccgcctccgcccggcgatccggtgccgccggtggatacgcacgccggcggccggcccgcggatcagttgcgcgaatgggcggagaaacgtgctgcggcattgggaattccggtcatcgcgctggaggcctacgcctacgccgctcgcgtcgccgaggtcgagaatcccaagtgtcatcttgcgtggaccacgctggcgggcatcgggcgggtggagagtcaccacggaacctaccggggcgccacgattgcgcccaatggggatgtaagccccccgattcggggcgtccgcctcgacggcaccggcggcaccctgcgcatcgtggacagggacgggggcggcctggacggtgacgccgcggtggagcgtgcgatggggccaatgcagttcatttcggaaacctggcggttgtacggggtcgctgccagaaacgacggcatcgccaacgtcgacaacatcgatgatgctgccctctcggcagcgggctatttatgctggcgtggaaaggatctcgcgacaccgcgagggtggataaccgcgctgagggcctacaacaactccgttatctatgcgcgggcggtccgggactgggcgaccgcgtatgcggcgggtcatccgctgtag

SEQ ID NO: 801 - DNA, 864 bp, Tuberculosis
atgagggcaagcccggcagacggtttagcgatcaccggcttatcctggaagggatcgcgtggcggttccgtacgggaagtccgtggcgggacctgcccgctgagttcgggccgtggcaaacggtgtggaagcgccatcaccgttggtcgctggatggtacctgcgacgaggtgttcgcccacgttgccgcggtgttcggggtggacgctgaggtggccgaggatatcgagaagctgctgtcggtggattccacgaacgtgcgggcacaccagcattcggcgggcgcctgctcggacacgctcgccacagggggcactgtcggattacaagaaatccgccgatgaacccgacgatcatgcgatcggccgctcgcgcggcgggctgaccaccaagatccatgccctgaccgatcagcgcgaagccccggtgcggatccggttgaccgcaggccaggccggcgacaacccgcaactgctgcccctgctcgacgactatcgccatgccagcaccgaatacgccctgggcagcacggatttccgcttactcgccgacaaggcctactcacacccaagtacccgtgccgcattacggtctaagaagatcaagcacaccatccccgaacgccaagatcagatcgaccggcgcaaggccaaggggtctgccggcgggcggccaccagcattcgacgccgcgctctacgggctacgcaacaccgtcgaacgcggcttccatcgactcaagcagtggcgcggcatcgcaacccgctacgacaaatacgccctgacctacctcggcggcgtcctgctggcctgcgccgtcatccacgcccgagtgggaactccgaaattgggagacacgccctag

SEQ ID NO: 802 - DNA, 756 bp, Tuberculosis
atgcgcgccgacgtcaccgccgagcatctcacccaggtggttcgcgacatcgccgtgatcgacatcgacgacggggtggcgttcaacctcgacacgagcagcgtgcaggaaattcgcgagcgggccgactacccgggcctgcgcgtgcgagtcgctatgtcggtcggaccgtggcagggcatcgcggcctgggatgtgtccaccggcgaaccgatcgcgccgtggcccacacgggtgaccatcgaccggatcctcggcgagccgatcacactcctgggctacgcgcccgagaccatcatcgccgagaagggagtgaccatcctcgaacgcggcatcaccagcacccgctggcgggactacgtcgacatcgtccaactcgaccgccggggcatcgacgacgacgagctgctccgctcggccagggcagtcgcacaataccgcggcgccactctcgaacccgtcgcgcctcacctggccggttatggcgcagtcgcgcaagcgaaatgggcgaccgaacacggacgctgccagcactgttggagacattggaaaccagcccatgtcgggaggagaaacatggatctgctggacgcaaaacaagtttcggagatgatcggcgttcccgtcggcactctacggcactggcggcactcggacatcggaccggcgagcttcaccttgggacggcgcgtcgtgtaccggcgcgacgaggtgtcgcgctggatctcaaagcgggagagcgcaactcgacgttga

SEQ ID NO: 803 - DNA, 765 bp, Tuberculosis
atgagcgtggattacccccaaatggctgctacccggggaagaatagaaccggccccgcggcgagttcgcggctatctcggacatgtgctcgtcttcgacaccagtgcggcgcgctatgtctgggaggttccctactacccgcagtactacatcccgctggcggatgtccgcatggagttcctgcgcgacgagaaccacccgcagcgagtgcagctgggtccgtcgcggctgcactccttggtaagcgccggtcagacccaccgatcggcggcgcgggtattcgatgtcgacggcgacagcccggtggcgggcaccgtgcgtttcaactgggatccgctgcggtggttcgaggaggacgagccgatctacggccatccgcgcaatccctatcagcgggccgatgcgctgcgctcgcaccgacacgtccgtgtcgagctggacggcattgtgctcgctgacacccgatcgcccgttctgctattcgaaactgggatacccacaaggtattacatcgatccggccgacatcgctttcgagcatctggagcccacctcgacgcagacgttgtgtccgtacaaggggacgacgtcgggctattggtctgtgcgcgtcggcgacgccgtgcaccgcgacctggcctggacgtatcactatccactgcccgccgttgccccgatcgccggcctggtggcgttttacaacgagaaggtcgacctcaccgtcgacggcgtcgccctgccgcggccgcacactcagttcagctag

SEQ ID NO: 804 - DNA, 2004 bp, Tuberculosis
gtgtcgtttgtgttggtgtctccgtcgcagctgatggccgcggcggccgatgtggccggtatcggttcggcaatcagcgcggccaacgcggccgccctggccccgacgtcggtgctggccgcggccggtgccgatgaggtgtccgcggcggtcgcggcactgttttccgcccacgccggccagtatcaacagctgggcgcgcgtgcagcgctgtttcacgagcagttcgtgcaggcattgaccggggcggcgagcgcgtatgccagcgccgaggcgaccaatgtcgagcagcaggtgctgggtttgatcaacgcgcccacccaggcgctgttggggcgtccgctgatcggcaacggcgccgatgggaccgcggccaatcccaacggtggcgccggtgggttgttgtacggcaacggcggcaacgggttttcccaaaccaccgccgggctcaccgggggtaccggcgggtcggccgggttgatcggcaacggcggcaacggaggggccggcggagccggcgccaacggcggcgcgggcggcaacggcggctggctctacggcagcggcggcaatggcggcgccggcggcgccggccccgccggagccatcggcgcgccgggcgtcgcgggtggtgccggcggggccgggggaacggccggattgttcggcaacggcggtgtcggcggcgtcggcggtgacggcggacaaggcggcaacggtgccggcgccggggccagcggcaccaagggcggtgacgccggcgccggcggggcgggcggtgccggcggctggatccacggccacggcggcgccggcggtgacggcggcgccggcggggccggcggacaagccagtcccggcgcccccggcccacccagccaaccgggcggcgccggtggtgcgggcggcgccggtggccgcggtggcgacggcgggtcggccggctggctgtccggcaacggcggtgacgccggcaacggcggcggcggcggcaccgccggcggtgccggcaacggcggccaattcggtggagacggcggcaccggcggcaccggcggcaccgccggcgccggcggcaacggcggacgaggcgccgtgctgttcggtcacggaggtaacgccgggcacggcggcgccggcggcaacggcgcggccgccggcgccggcggcgaacatgtcgtggccaccgccggtaagggtggtacgggtggtgtcggcggcgacggcggcggcggcggcgccggtggtggcggtgggctgctgtatggcaacggcggggccggcggcgccggcaactccgggggcgacggcggcaccgggctcaacgccgcactaggtggtaacggtggcggtggcggtgtcggcggcaacgccggggccggcggcaccggcgggtcggccggctggctgtcgggcaacggcggcgccggcggtagcggcggcagcgccggagccggcggcgccggcggaaagggcggcgacacccccaacggtctggccatcaatcccggtatcggcggcaacggcggggacaccggcaacgccggcaacggcggcaacggcggatcggccgccaggctgttcggtggcggcggcgccggcggcgccggcggaacgggcagcaccgccggcagcggcggcagcggcggcaccaacccgccgaccgggcttcaagccgccggcggtaacggcggcagcggtcacgcgggcggtcacggcggcaacggcggcggcgccggcctgctcggcggcggcggcaccggcggcaacggcgggggcggcggccaaggcggtctgggcgccgccgccggcggtgtcgacggcaacggcggcaacggcggcaacggcggcaagggcggcgacgcccagttggtcggtgacggcggcaacggcggcaacggcggcaagggtggcgccggcctgatcgccggactcgacggcgccggcggcgccggcggaactcgaggactcatcttcggcaacgccggcacgccggggcagtaa

SEQ ID NO: 805 - DNA, 867 bp, Tuberculosis
gtgagcgaactgcggttgatggcggtgcacgcccaccccgatgacgagtccagcaagggcgcggccaccctggcgcgctacgccgacgagggtcatcgcgtgctggtggtgacgttgaccggtggtgagcgcggcgagatcctcaacccggcgatggacctgccggacgtgcatgggcgcatcgccgagatccggcgtgacgagatgaccaaggcggccgagatcctcggtgtcgagcacacctggctgggcttcgtcgactccgggctacctaagggtgatttaccgccaccgctgcctgatgactgcttcgcgcgggtaccgctggaggtgtccaccgaggcgctggtgcgggtggttcgcgagtttcggccgcacgtgatgaccacctacgacgagaacggcggctacccacatcccgaccacattcgctgccatcaggtttcggtggctgcctacgaggcggccggtgacttttgccggtttcccgacgcgggtgagccgtggacggtgtccaagctgtactacgtccacggcttcctgcgggagcggatgcagatgttgcaggatgagttcgcccggcacggccaacgcggcccattcgaacaatggctggcgtactgggaccccgaccatgactttctcaccagccgagtgaccacccgggtcgagtgctcgaaatacttcagccaacgcgacgatgcgttgcgcgcgcatgccacccagatcgacccgaacgccgaattcttcgccgccccgcttgcctggcaggagcggctgtggccgaccgaggaattcgagttggctcgctcgcgtatccccgcgcgcccaccggagaccgaattgttcgccgggatcgagccgtga

SEQ ID NO: 806 - DNA, 987 bp, Tuberculosis
atggagctggtccgggtgaccgaggccggagccatggccgcgggccgctgggtaggccgcggcgacaaggagggcggcgacggcgcggcggtcgacgcgatgcgcgaactggtcaactcggtttccatgcgcggggtggtggtcatcggcgaaggcgaaaaggaccacgcaccaatgctctacaacggcgaagaagtgggcaacggcgacggaccggaatgcgactttgccgtcgaccccattgacggcaccacgctgatgagcaagggcatgaccaacgccatctcggtgctggcggtagccgatcgcggcaccatgttcgacccgtcggcggtgttctacatgaacaaaatcgccgtcggccccgatgccgcacacgtgctggatatcaccgcgccgatctcggaaaacatccgagcggtcgccaaggtcaaggacctgtcggtgcgagacatgacggtgtgcatcctggacaggccgcggcacgcgcaactcatccacgacgtccgcgccaccggggcccggatccggctgatcaccgatggcgacgtcgccggcgcgatctcggcgtgccgaccgcactccggcaccgacctgctagctgggatcggcggcaccccggagggaatcatcgccgccgcggcgatccgctgcatgggcggggcgatccaggcgcagctcgccccgcgcgacgacgcggaacgccgcaaggccctagaagccggttacgacctgaaccaggtcttgaccaccgaagatctggtgtccggggaaaacgtcttcttctgcgccactggggtcaccgacggcgacctgctcaagggagtgcgttactaccccggcggctgcaccacccattcgatcgtgatgcgctcgaagtccggcaccgtccggatgatcgaggcctaccaccggctttcaaagctcaacgaatactccgcgatcgacttcaccggcgacagcagcgccgtgtacccattgccctaa

SEQ ID NO: 807 - DNA, 321 bp, Tuberculosis
atgtacctaccctggggggtcgtcctcgccggcggcgcgaacggttttggggcgggtgcataccaaactggtaccatctgtgaagtgagtacacagattgcggttcgcttgcccgatgagattgtcgcgttcatcgacgacgaagtccggggacagcatgcccgtagccgtgcggctgtcgtgctgcgggcgctggaacgggaacgccgccgtcgtctcgccgaacgcgacgcggagatcctcgccaccaacacgtcagccacgggtgatctggatacgctggccggccactgcgctcgtaccgccctcgacatcgactga

SEQ ID NO: 808 - DNA, 861 bp, Tuberculosis
gtgcaatcgggcccgcacctcgtcgggcgtgtaggcacgtcgtttccgttgatcgcgcgccaccagggcgccacccgcgacgacgccggcgacaccggccagcccgacccacttccacacgttgcgcaccccgacaggctatatccgcctatggtgcatggggtggacccgagcacgctagcgctggatcgagcgctgaacgaaacccgcaccggcgacctctggctgtttcgcggccgttcccgacccgaccgggcgatccagaccttgacgaacgccccggtgaaccacgtcggcatgacggtggccatcgacgacttgccgccgctgatctggcatgccgaactgggcgacaagctgctcgacgtatggaccggcaccaaccaccgcggcgtgcagctcaacgacgcccgccaagtcgtgcagcagtgggccggccgttatcggcagcggtgctggctgcgtcaactgacaccgcacgccaatcgcgaccaggaggacaaactgctgcgggtcatcgcgcggatgaacggcacgcctttcccaaccaccgcccggttgaccggccggtggctgcgcggccggcttccgaccctcaacgattggctgcgcggcataccggtgctggaccgcaaggtgcgcgaacaaacccagcgacgtaagcaacagcagcgcacgatgggcctggcgacggcatattgcgcggagacggtggccatcacctatgaggaaatgggattgctggtcaccgacaaggacgcgcactggttcgaccccggcaagttctggagcggtgactcgctgcccctggcgccgggttatcggctgggtcacgaaatcgcggtcgacgtgggcggctga

SEQ ID NO: 809 - DNA, 366 bp, Tuberculosis
gtggagctgcgggattggttacgggtcgacgtgaaggcgggaaagccgttgttcgaccagctcagaacccaggtgatcgacggagtccgcgccggcgcattgccgcccggcacccggctcccgacggtgcgtgacttggccgggcagctgggcgtggcggccaataccgtggcccgcgcctaccgcgagttggaatcggcggcgatcgtcgaaacgcggggacgcttcggcactttcatttcccgcttcgatccgaccgacgccgcgatggctgccgcggccaaggaatatgtcggcgtggcgcgagcgctggggctgacgaagtccgatgcgatgcgctatctcacccacgtgccggacgactga

SEQ ID NO: 810 - DNA, 642 bp, Tuberculosis
atggagtttccactgattacggccaacagcttgtcgtcgaagacttggcgggccatgccaagagcctacgtcgccgttgcgtcattctccggcggcctggtgcaatcgggtatggccaagttcgcggcgtttctgcgcggtgtcaacgtcggcggcgtcaacctcaagatggccgaggtggcgacggcgttgaccgatgcgggattctgcaatgtgcgcaccatcctggccagcggcaacgtgttgctggagtcgacgtgcggtgccgcggaagtgcgcgagaagaccgaagccacgctacgcgaacgattcggctacgacgcgtgggcgttgatctacgacgtcgatacggtgcgcaccatcgtgacggcatacccatttgaatgcgagctcgagggataccagtcgtacgtcaccttcgttgccgacgccgcgatactcgacgagctatccgcactcgccgacacagccggccctgacgagaacatcagtcgtggacccgaccctcttggcgtcctctactggcaggtacccaagggcagcaccctggacagcaccatcggccagacgatgggcaagaagcgctacaagtcgtcgaccacgacccgcaacctgcgcacgctggctaaggtgttgcggtga

SEQ ID NO: 811 - DNA, 1116 bp, Tuberculosis
gtgagaaggctgaccaacaccgaacaccgggagaacaccaccgtggcaagcacttggagtgtgtgcaaaggtttggccgccgtcgtcatcacctcggctgccgcgttcgcgctgtgtccgaacgcggcagccgacccggcgacgccgcagcccaaccccactcaacagctaccgggcttgccggcgttggcccagctgagtccgataatccagcaagcggcgatgaacccggcacaggcgacgcaactgctcatggccgcagcgtctgcgttcgccggcaatccggcagtgcccaccgaatccaagaacgtcgcttcctcggtgaaccagtttgtggctgagccgaccaatcccgactctgctgccctgggtgtgccggcgcctcatggtgtcgccctgcccgaggccatcccggtgccgcatgtgcccccactgggcgccgagccaggtgtgcaggcacatcttccgaccggcatcgatccatcccacgccgcgggccccgcacccgctgtggcacctacggttacgccgccggtcgccgcgccgccggcttccgcgccggcaccagcacctgacgcagcccaaccggttgcggtaccggggccgccaccggcgccacctgcgccgcgcgccgccgctccggcgccggcctcggcggcaccggcgccagcggccgctccggcgcctgcctcgggcttcggcgccgacgctccgcccacacaggacttcatgtacccctcgatcggccccaattgtgtggcggacggcagcaattccatcgcgaccgcgctgtcggtggcggggcccgccaagatcccgctgcccggtcccggacccggccagaccgcctacgtgttcacggccgtcggcacgccggggcccgccgacgtgcagaggttgccgctgaacgtcacgtgggtgaacctgaccacgggaaagtccggcagcgccaccctgcggccgcgttcggacatcaatccggacggaccgaccacgttgaccgtaatcgccgacaccggttcaggcagcatcatgtcaacgatcttcgggcaggtgaccaccaaggaccggcagtgccagttcatgccgacgatcggctcaacggtggtgccctag

SEQ ID NO: 812 - DNA, 426 bp, Tuberculosis
atgctgaatcagatcgtggttgccggagccatcgtccgcggttgcacggtcttggtggcgcaacgcgttcggccaccggagttggcgggtcgttgggaacttcccggcggtaaggtcgccgccggcgaaaccgagcgcgccgcgctggcccgagagctcgccgaagaactgggactcgaggtcgccgacctcgcggtgggcgaccgtgtgggcgacgatattgcgttgaacggcacgacgacgctgcgggcctatcgcgtgcatctgcttggcggcgaaccgcgtgcgcgtgaccaccgggcgctgtgctgggtgacggcggccgaactgcacgatgtcgactgggtaccagccgaccgcggctggattgcggacctggcgcgaaccctcaacgggtccgccgcagatgtccaccgtcgctgttag

SEQ ID NO: 813 - DNA, 873 bp, Tuberculosis
atgtcgcaacacgacccggtaagtgcggcctggcgggcgcatcgggcctacctggtggacctcgcgtttcgtatggtaggtgacatcggcgtggccgaagacatggtgcaagaggcattttcccgcttgctgcgggctccggtcggcgacatcgacgacgagcgtggctggctgatcgtggtcaccagccggctgtgcctggatcacatcaagtcggcgtcgacacgccgggagcgcccgcaggacatcgccgcatggcacgacggtgacgccagcgtgtcatcggttgacccggctgaccgggtgactctcgacgacgaggtccggctggctttgctgatcatgctcgagcgcctcggccccgcggagcgggtggtgttcgtgctgcacgagatctttgggctgccctaccagcaaatcgccacgacgattggcagccaggcctccacatgccggcagctggctcatcgggcccgtcgcaagatcaacgaatcgcgcattgcggccagcgtggagccagcccagcatcgcgtcgtcaccagagctttcatcgaagcctgctccaacggagacctggacaccctgctcgaggtgctggatccgggtgtcgccggcgagatcgacgcccgcaaaggcgttgtcgtcgtgggcgcggatcgggttggcccgaccatcctgcgccactggagtcaccccgccaccgtcctggtagcccagccggtgtgcggtcaaccggcggtgctggcctttgtcaaccgagcgcttgccggcgtgttggccctgtcgatcgaggccggcaagatcacaaaaatccatgtcttagtgcagccttcaacattggacccgttacgggccgaactcggcggcggttag

SEQ ID NO: 814 - DNA, 648 bp, Tuberculosis
atgcctggccagccggcccccagccgaggcgaatcactctgggcgcacgccgaggggtcaatatctgaagacgtgatcctggccggcgcccgcgagcgcgcaaccgacatcggggccggggcggtaacaccggcggtgggtgcgttgctgtgcttgctggccaagctcagcggaggcaaggcggtggccgaagtgggtaccggggccggcgtcagcggcctgtggctgttgtcgggcatgcgcgacgacggcgtcttgaccaccatcgatatcgagcccgagcatctacgccttgccaggcaggcctttgccgaggcgggcatcgggccgtcgcgtaccaggctgatcagcggccgcgcccaagaggtgctgacccggctcgccgacgcatcctacgacctggtattcatcgacgccgacccgatcgaccagccagattacgtcgccgagggggtgcggctgctgcgatccggcggggtcatcgtcgtgcaccgggcggcgctgggcggtcgggccggtgatcccggggcgcgcgacgccgaggtgatcgcggttcgcgaggcggcccggcttatcgccgaggatgaacggctcactccggcactggtgccgctgggcgacggcgtgctggcagccgtgcgggactaa

SEQ ID NO: 815 - DNA, 1689 bp, Tuberculosis
atggagtatctgattgcagcgcaggacgtgttggtggccgcggccgctgatttggagggcatcggctcggcgctggccgcagctaacagggcggccgaggccccgaccacggggctgctggccgcgggtgccgacgaggtatcagcggccatcgcgtcgctgttttccgggaacgcccaggcctatcaagcgctgagcgcacaggcggcggcatttcatcagcagtttgtgcgggcactgagttcggcggccggctcgtatgcggcggccgaggccgccaatgcctccccgatgcaagcggtgctggatgtggtcaatgggcccacccagctgttgctggggcgcccgctgatcggcgatggcgccaacggcgggccgggacaaaacgggggcgacggtggcttgttgtacggcaacggcggcaacggcggctcgagtagcaccccaggccagcccggcggtcgcggcggcgcggccgggttgatcggcaacggtggcgccgggggagccggcgggcccggcgcgaacggcggtgccggcggcaacggcgggtggctatacggcaacggtgggctcggcggcaacggtggggcggccacccagatcgggggcaatggcggcaacggaggccacggcggcaacgccgggctatggggcaacgggggggcgggtggagccggagcggcaggagcggccggcgccaacgggcaaaacccggtgtcccatcaggtcacgcacgcgaccgatggcgccgacggcactaccggacccgatggcaacgggaccgacgccggctcgggcagcaacgcagtcaaccccggcgtgggcggtggtgcaggcggcataggcggggatggaaccaaccttgggcagaccgacgtgtccgggggtgccggcggcgacggcggcgacggcgccaacttcgcctccggaggtgccggcggtaacggtggcgccgctcaaagcggctttggtgacgctgtcggcggcaatggcggcgccggcggaaacggcggagccggcggcggcggggggctgggcggagcgggtggcagcgccaatgttgcaaatgctggcaacagcatagggggcaacggtggcgccggcgggaacggcggtatcggcgctcccggtggtgccggcggcgccggaggaaatgccaatcaagataatcctcctgggggcaactccaccgggggcaatggtggtgccggcggcgacggcggcgtcggtgcctcggctgacgttggtggcgccggcggctttgggggcagcgggggtcgcggcgggctactgctcggcacgggcggcgccggcggcgacggcggcgtcgggggcgacgggggcatcggcgctcaaggcggcagcggcggcaacggcggcaacggcgggatcggcgccgacggcatggccaaccaggacggcgacggcggtgacggcggcaacggcggcgacggcggggccggcggggccggtggcgtcggcggaaacggcgggaccggcggtgcgggcggactgttcggacagtcgggcagccccggctccggcgcggccgggggcctcggcggcgcgggcggcaacggcggcgcgggcggcggcggcgggaccgggttcaaccccggcgcccccggcgatcccggtactcaaggcgctaccggcgccaacggtcagcacggcctgaacggctga

SEQ ID NO: 816 - DNA, 1812 bp, Tuberculosis
atgtcgtttgtaatcgccgctcccgagacgctggtgagggccgcttcggatttggcgaacatcgggtcgacgctgggggccgccaacgccgcggcattgggcccgacgacggaacttctggcagccggtgctgatgaggtgtcggcggccatcgcgtcgctgttcgccgcgcatggccaggcctatcaggcggtgagcgctcagatgtcggcgtttcatgcccagttcgttcaaacctttactgcgggcgctggcgcgtacgcgagcgctgaggccgccgccgcggcgccgttggagggcctgctcaacattgtgaacacgcccacccagctgttgctggggcgtccgctgatcggcaacggcgccaacggcgcaccggggaccgggcaagccggcggggccggcgggctgctgtacggcaacggcggggccggcgggtccggggcgcccggccaggccggcggcccaggtggagccgcggggctattcggcaacggcggggcgggtggggccgggggtgacggcccgggcaacggcgcggctggcggggccggcggggccggcgggctgctgttcggctccggcggcgccggtgggcccggcggagtcgggaacaccggcacaggcgggctcggcggcgacggcggggcggccgggctgttcggagccggtggcatcggcggggccggcgggccaggcttcaacggtggcgccggcggggccggcggtcgcagcgggctgttcgaggtgttggccgccggcggtgccggcggcaccggcgggttgagcgtcaacgggggcaccggtggcaccggcggcaccggcgggggcggcgggctgttctccaatggcggtgccggcggcgccggcgggttcggagtctccggctcggccggagggaacggcggcaccggaggcgacggcggcatcttcaccggcaacggcgggaccggcggcaccggcggaactggcaccggtaaccaactcgtgggcggtgagggcggggccggcggggcgggcggcaacgccggcatcctcttcggcgctggcggcattggcggcaccggcggaaccggtctcggcgcgcccgaccccggcggcaccggcggcaaaggaggcgtcggcggcatcggcggtgccggcgcactgttcggtcccggcggcgccgggggcaccggagggttcggcgcctccagtgcggaccaaatggccggcggcatcggcgggtccggtggcagcggcggggccgccaagctgatcggcgacggcggcgccggcggtaccggcggcgacagcgtccggggcgcggccggtagcggcggcaccggcggcaccggcgggttgatcggtgacggcggcgctggtggcgccggcgggactggcatcgaattcgggtcggtcgggggggccggcggggccggcggcaacgccgccgggctctcgggtgcgggcggggccggcggagccggcgggttcggcgagaccgccggcgacggtggggccggcggcaacgccggcctgctcaacggcgatggcggcgccggcggcgccggcggactcggcatcgccggcgacggggggaacggcggcaagggtggcaaggccgggatggtcggcaacggcggcgacggcggcgccggcggcgcaagcgtggtggcaaacggcggtgtcggcggctccggcggcaacgccaccctgatcggcaatggaggcaacggcggaaacggcggagtcggcagtgcgccgggtaagggtggcgccggcggcaccgccgggctgctcggcctgaacggatcacccgggttgtcgtag

SEQ ID NO: 817 - DNA, 960 bp, Tuberculosis
atgaccccaaggcacctgctgaccgccgccgacctcagccgcgacgacgccaccgccatcctcgacgacgccgaccggtttgcgcaggcgctggtcggtcgcgacatcaagaagctgccgacgctgcggggccggaccgtcgtcacgatgttctatgagaactccacccgcacccgggtgtcgttcgaggtagcgggtaagtggatgagcgccgacgtgatcaacgtcagcgctgccggatcttcggtaggcaagggtgagtcgctgcgggataccgcgctgaccctgcgcgcggccggggctgacgcgctgatcatccgccatcccgcgtccggcgccgcccatctgctggcgcagtggaccggcgcccacaacgatgggccggcggtgatcaacgccggtgacggcactcatgaacaccccacgcaggcgctgcttgatgcgctgaccatccgtcagcgcctcggcggcatcgaaggccggcgcatcgtgatcgtcggcgacatcctgcacagccgggtcgcccgctccaacgtcatgctgctggacaccctgggcgccgaggtggtgctggtggcgccacccacattgctaccggtcggggtgaccggctggccggccaccgtctcccacgacttcgatgccgagctgcccgccgccgacgcggtattgatgctgcgggtacaggccgagcggatgaacggcggttttttcccgtccgtacgggagtactcggtccgctacgggctaaccgagcggcgccaggcgatgcttcccggccacgccgtggtgttgcacccgggaccgatggtgcgtggcatggagatcacatcttcggtcgcggactcgtcgcaatcggctgtgctgcaacaggtttccaatggagtccaggtgcggatggcggtgctgttccatgtgctggtgggagcgcaggatgccggtaaagagggtgcggcgtga

SEQ ID NO: 818 - DNA, 963 bp, Tuberculosis
atgcccagtttggacaacaccgccgacgagaaacccgcgatcgaccccatcctgctgaaggtactggatgcggttccgtttcggctatcgatcgacgatgggatcgaggccgtgcgccagcggttgcgcgatctaccgcgccagccggtgcaccccgagctgcgggtcgttgaccttgcgatcgatggaccggcggggccgatcgggacccggatctattggccgccaacgtgtcccgatcaagccgaggcgcccgttgtgctgtatttccatggcggcggattcgtcatgggcgacctcgacacgcacgatggcacctgccgccagcacgccgtcggcgctgacgcgattgtcgtgtccgtcgactaccggctggcgcctgagcacccctaccccgctgccatcgaagatgcttgggccgcaacgcggtgggtcgccgagcatggccgccaggtcggtgctgacctcggccgcatcgccgtcgccggagattccgccggcggcaccatcgccgcggtgatcgcgcagcgagcccgcgatatgggcggcccgcccattgtgtttcagctgttgtggtatccctccactctgtgggaccaatcgctgccgtcgttggccgagaatgccgacgcaccgatcctcgacgtcaaggcaattgccgcgttctcccgttggtacgcaggcgaaatcgacttgcacaacccgccagcgccaatggcgcccggccgagcggagaacctggccgacctgccgccggcctacatcgctgtcgccggctacgaccctttgcgcgacgacgggattcggtacggcgagctgctggccgccgccggtgttcccgtcgaggtgcacaacgcccagacgctggtgcacggctacgttggctatgccggtgtggtgcccgccgccaccgaggccaccaaccgtgggctggtggcgctacgggttgtgctacacggatag

SEQ ID NO: 819 - DNA, 711 bp, Tuberculosis
atgcggacccccagacgccactgccgtcgcatcgccgtcctcgccgccgttagcatcgccgccactgtcgttgccggctgctcgtcgggctcgaagccaagcggcggaccacttccggacgcgaagccgctggtcgaggaggccaccgcgcagaccaaggctctcaagagcgcgcacatggtgctgacggtcaacggcaagatcccgggactgtctctgaagacgctgagcggcgatctcaccaccaaccccaccgccgcgacgggaaacgtcaagctcacgctgggtgggtctgatatcgatgccgacttcgtggtgttcgacgggatcctgtacgccaccctgacgcccaaccagtggagcgatttcggtcccgccgccgacatctacgaccccgcccaggtgctgaatccggataccggcctggccaacgtgctggcgaatttcgccgacgcaaaagccgaagggcgggataccatcaacggccagaacaccatccgcatcagcgggaaggtatcggcacaggcggtgaaccagatagcgccgccgttcaacgcgacgcagccggtgccggcgaccgtctggattcaggagaccggcgatcatcaactggcacaggcccagttggaccgcggctcgggcaattccgtccagatgaccttgtcgaaatggggcgagaaggtccaggtcacgaagcccccggtgagctga

SEQ ID NO: 820 - DNA, 609 bp, Tuberculosis
ttgacgctgatggcgatcgtcaatcggttcaacatcaaagtaattgccggcgctgggttgtttgcagctgctatagcgttaagcccggacgcggcggctgacccgctgatgacgggtggctacgcgtgcatccagggcatggcgggcgacgcgccggtagccgccggcgacccggtggctgccggtggaccggcagccgcgggagcgtgcagtgccgcacttactgacatggctggtgttccgttcgtcgcgcctgggccagtgccggcagctgcaccggtgcccatcggcgcaccggtaccaatccctggcgcaccggtaccgataccgggcgcaccggtaccaatccccggcggaccggtaccgataccgggcgcaccggtaccggtacccgccgttccggctccggtgataccggtcggaactccgctgattgcgcttgggccggtcctggctggtgctcccggggatggtgtggtcagtgctcccatcattggcatgtccggggtcaaggatgcgctgaccgatccggcgccagctggcggaccggtgcctggtcagccggttctgcccggtccttcggcctctgcgcccgcaggtgcgcgctga

SEQ ID NO: 821 - DNA, 1476 bp, Tuberculosis
atgtcgaacgtgatggtagtcccgggaatgttgtcagcggcggcagcggatgtggcgagcatcggtgcggcgcttagcgcggccaacggagccgcggcacccacgacggctggtgtcctggccgccggggccgatgaggtgtcggcggccatcgcgtcgttgttttctggctacgcccgcgactatcaggcgctcagtgcccaaatggccagatttcatcaacagttcgtgcaggccttaaccgcgagcgtgggctcgtatgccgccgccgaggccgccaacgcctcccccttgcaggccctcgaacaacaggtgctcgcggccatcaacgcgcccacccagacactgctggggcgtccgctgatcggcaacggcgccgacgggctgcccggtcaaaacggtggggccggcgggttgctgtggggcaacggcgggaacggcggagccggcgacgccgcccaccccaacggcggcaacggcggggatgccggaatgttcggtaacggcggggccggcggtgccggttacagcccggcggccggaaccggcgcggccggtggagccggcggcgccggtggagccggtggctggctaagcggcaacggcggcgccggcggcaacggcggtactggcgccagcggcgccgacggcggcggcggcctcccccccgtccccgccagccctggcggtaacggcggtggcggtgatgccggtggtgctgctgggatgttcggcaccggcggcgccggtgggaccggcggggacggcggcgccggcggtgccggcgacagtcctaacagcggtgccaacggcgcccgtggcggcgacggcggcaacggcgctgcgggtggggctggtggccggctgttcggcaatggcggcgccggcggcaacggcggcaccgctggccaaggtggcgacggcggcacggcgctaggcgctggcggcatcggcggcgacggcggcaccggcggcgccggtggtactggcggcacagctggcatcggcggcagcagcgccggcgccggcggcgccggcggcgacggcggcgccggcggcaccggcggcggcagctcaatgatcggcggcaaaggcggtaccggcggcaacggcggcgtcggtggcaccggcggcgccagcgcattgaccatcggcaatggcagcagcgccggcgccggcggcgctggcggcgcaggcggcaccggcggcaccggcggctatatcgaaagcctcgacggcaaaggccaagccggcaacggcggcaacggcggcaacggcgccgcgggtggggcaggcggaggcggcaccggcgccggcggtaacggcggcgccggcggcaacggcggtgacggcgggcccagccaaggtggcggcaatcccggctttggcggcgacggcggcaccggcggacctggcggcgtcggtgtgcccgacgggatcggcggcgccaatggcgcgcaaggaaagcacgggtga

SEQ ID NO: 822 - DNA, 864 bp, Tuberculosis
atgaagcttgcccggccggacgtcttccatccgcgcgtcgttttggcgggttggccacagcagcccgccggtgacggcgacgatgctgggctggttgcggccctgcgccaccgcggcttgcatgctggttggctgtcttgggacgatcccgaaatagtccacgcggatctggtgattttgcgggctacccgcgattaccccgcgcggctcgacgagtttttggcctggactacccgcgtggccaatctgctgaactcgcggccggtggtggcctggaatgtcgagcgccgttacctacgtgacctgatggatcggggggtgccgaccgtgcccggcgaggtgtatgtgccgggagagccggtccggttgccacgcaaaggccaggtcttcgtcggtccgaccatcggtaccgggacacggcgctgtagtgcccggttcgctgccgagttcgtcgcgcaactgcacgcggccggccaggcggtgctcgttcagcccggaggttccggtgacgagaccgtgttggtcttccttggcggtgagccgtcgcatgcgtttaccaagcaggccgacacttggcgccagaccgagcccgacttcgaaatctgggacgtgggtgcggccgccgtggccggcgcggccgcgcaggtgggtgttgacccaggtgagctgctctacgcgcgggcccacatcacaggtggaagccgagatccccggttgctggaattgcaattggtggacccgtcgctgggctggcagtggctggacccagacatccgcaatcttgcccagcgtgacttcgcgctatgcgtccagtcagcgttggagcggctggggctgggcccgttctcccatcgacgcccatag

SEQ ID NO: 823 - DNA, 801 bp, Tuberculosis
atgaccattttggaaattaaggacctgcacgtcagcgtggagaaccccgcggaggcggaccacgagatcccgatcctgcgcggcgtcgacctcaccgtgaaatccggtgagacacatgccttgatgggacccaacggctcgggcaagtcgacgctgtcctacgccatcgcgggccatcccaaataccacgtgacgtcgggcaccattaccctcgacggcgcggacgtgctggcgatgagcatcgacgaacgtgcgcgggccggcctgtttctggccatgcaatatcccgtcgaggtgcccggtgtctcgatgtcgaacttcctgcgctcggcggcaaccgccattcgcggcgagccgccgaaactgcggcactgggtcaaagaggtcaaggccgcgatggccgcgctcgacatcgacccggccttcgccgagcgcagcgtcaacgagggtttctccggtggcgagaagaagcgccacgagatcctgcagctagaactgctcaagcccaagatcgccatcctggacgagaccgactccggcctggacgtcgacgcgctgcgcgtggtcagcgagggggtgaaccgctacgccgaatcccagcacggcggcatcctgctgatcacgcactacacccgcatcctgcgctacatccacccggaatacgtgcacgtgttcgtcggcggccgcatcgtcgagtccggtggttcggagctcgccgacgaactcgaccagaacggctacgtgcgtttctcccccgcaagcgggcggtacccccaccaacccgcgccaaccggagcctga

SEQ ID NO: 824 - DNA, 372 bp, Tuberculosis
gtgactacccgagacctcactgccgcacagttcaacgaaaccatccaaagcagcgacatggtgctcgtcgattattgggcctcctggtgcggcccgtgccgcgcgttcgcgccgacctttgccgagtcgtcggaaaaacaccccgacgtggtgcacgccaaggtcgacaccgaagccgaacgagagcttgcagcggccgctcagatccgatccatccccacgatcatggccttcaagaacggcaagttgttgttcaaccaggccggcgcgctgccgccggcagcattggagagcctggtgcagcagctcaaggcctacgaggtggaggccggcgaagccaccacccagaacgggcgagcccaacaagcctga

SEQ ID NO: 825 - DNA, 867 bp, Tuberculosis
atgtggtgtcccagtgtttcgctgtcgatctgggctaacgcttggctcgccggcaaggctgctcccgacgacgtgttggatgcattatcactttgggcgccaacgcaatccgtcgcagcttatgatgccgtggctgcgggccacaccgggctgccgtggcccgacgtccacgatgctggaacggtctcgctcctgcagacactgcgcgccgcggtgggccggcgccgactgcgggggacgatcaatgtggtgttgccggtgccgggcgatgtgcgcgggctggctgcgggaacacagttcgagcacgacgcccttgccgccggcgaggcggtgatcgtcgccaacccggaggatcccggcagcgccgttggcctggtcccggagttctcctatggcgatgtcgacgaagccgcgcagagcgagccactcacgcccgaattgtgtgcactttcttggatggtgtattcacttcccggggccccagtgttggaacactacgagctcggcgatgccgaatacgcgttgcggtcagcggtgcgctcggccgccgaagccttgagcaccatcggactgggatctagcgacgtcgccaagccccgtggcctcgtcgagcagttgctcgaatcgtcacggcaacaccgggttcccgaccacgcgccatcgcgcgcattgcgggtgctcgagaatgccgcgcacgtcgatgcgatcatcgcggtcagtgccgggctgagtcgattgccgatcggaacgcagtcgttgtcggacgctcagcgtgccaccgatgcgttgagaccgttgaccgccgtggtgcgctcggcccggatgtccgcggtcacggcgatcctgcactcggcctggccggactga

SEQ ID NO: 826 - DNA, 435 bp, Tuberculosis
atgcccgtcgctttgatctggcttatcgcggcgttggtgctcgtcggcgcagaggcactgaccggcgacatgttcttgctgatgctcggcggcggtgcgctggccgcctcggtaagcagctggctgctggcttggccgatgtgggccgacggggcggtgtttctcctcgtctcggtgctgctgctggtgttggttcggccggcggtgcggcgccggctgacgcagaccaaaggtgtgcagctgggcatcgaggcgctggagggtaagaaggcggtggtgcttggtcgggtggcccgcgacgggggtcaggtgaagctggacggccaggtgtggacggcgcgcccgctcaacgacggtgatgtgttcgaacctggtgactcggtgaccgtggtgcaaatcgacggcgccacggcggtggtcttcaaggacgtgtag

SEQ ID NO: 827 - DNA, 732 bp, Tuberculosis
atgaggctggcccgtcgcgctcggaacatcttgcgtcgcaacggcatcgaggtgtcgcgctactttgccgaactggactgggaacgcaatttcttgcgccaactgcaatcgcatcgggtcagtgccgtgctcgatgtcggggccaattcggggcagtacgccaggggtctgcgcggcgcgggcttcgcgggccgcatcgtctcgttcgagccgctgcccgggccctttgccgtcttgcagcgcagcgcctccacggacccgttgtgggaatgccggcgctgtgcgctgggcgatgtcgatggaaccatctcgatcaacgtcgccggcaacgagggcgccagcagttccgtcttgccgatgttgaaacgacatcaggacgcctttccaccagccaactacgtgggcgcccaacgggtgccgatacatcgactcgattccgtggctgcagacgttctgcggcccaacgatattgcgttcttgaagatcgacgttcaaggattcgagaagcaggtgatcgcgggtggcgattcaacggtgcacgaccgatgcgtcggcatgcagctcgagctgtctttccagccgttgtacgagggtggcatgctcatccgcgaggcgctcgatctcgtggattcgttgggctttacgctctcgggattgcaacccggtttcaccgacccccgcaacggtcgaatgctgcaggccgatggcatcttcttccggggcagcgattga

SEQ ID NO: 828 - DNA, 693 bp, Tuberculosis
atgaaacgcagcatgaaaagcggctccttcgcgatcggtctggcaatgatgctcgccccgatggtggccgcgcccggtcttgcggccgcagacccggccacgcggccggtggattatcaacagatcaccgacgtcgtgatcgcgcgcgggctgtcgcagcgcggcgtgccgttctcctgggccggcggcggcatcagcggccccacgcgcggcaccggtaccggcatcaacaccgtcgggttcgacgcctccggtttgatccagtacgcctatgccggtgccgggctaaagctgccgcgttcttccggccagatgtacaaggttgggcaaaaggtcctgccgcagcaagcgcgcaagggcgacctgatcttctacggccccgaaggcacgcaaagcgtcgcgttatacctcgggaagggccagatgctggaggtgggcgacgtcgtccaggtttcgccggtgcgcaccaacggcatgacgccttacctggtccgggttctcgggacccagccgacgcccgtccaacaggcgccggtccagccagcgccggtccagcaagcgcccgtccagcaagcgcccgtccaacaggcgcccgtccaacaggcgccggtccaacaggcgccggtccagcaagcgcccgtccagcaagcgcccgtccagccgcctcccttcggcaccgcgcgctcacgctaa

SEQ ID NO: 829 - DNA, 738 bp, Tuberculosis
gtgatgccgctgatacttttgcccgccgtcgacgtggtcgagggtcgtgccgtgcgcctcgttcaagggaaggccggcagccaaaccgagtacggctcagcggtggatgccgcgttgggctggcaacgcgatggcgccgagtggatccatttggtggacctggatgctgcgttcggccgcggttccaaccacgaactgcttgccgaggttgtcggcaagctcgacgtacaggttgagctatccggcggtattcgagacgacgagtcgctggccgcggcgctggccaccggatgcgctcgggtcaatgtgggcactgctgccctggaaaacccgcagtggtgtgcccgggtgattggcgagcacggcgaccaggtcgccgtcggcttggacgtccagatcatcgacggcgagcatcggttgcgcggacgcggctgggaaaccgacggcggcgacctgtgggacgtgctagaacgcctagacagtgaaggatgttcgcggttcgtcgtgaccgatatcaccaaggacggcaccctgggcggccccaatctggacctgctggccggtgttgccgaccgcaccgacgccccggtgatcgcgtccggaggtgtgtccagcctcgatgacctgcgcgccattgcgactctcacgcaccgcggcgtcgagggggccatcgtcggcaaggccctctacgcccgtcggttcaccttgccgcaagcgttggccgcggttcgggactag

SEQ ID NO: 830 - DNA, 795 bp, Tuberculosis
atgctatgtgcccgtaccgacaaccatcaggggaccggtaacgtcgtaacgtcggcgcatatgacccgcgccaacgacgatgatgccggcgcagccggcataggagcagtggcgcatatgacaacagtcgacgacaactacaccggacacgtcgaacgcggcaaggcggcgcgtcgcttcctgcccggcgccacgatcctcaaggcatcggtgggcccgatggacaacaacgcctacctggtgacgtgttcagcgaccggagaaaccctgctgatcgacgccgccaatgacgcggaggtcctcatcgacctggtccggcggtacgcgccgaagctggccctgatcgttaccagtcaccagcacttcgaccactggcaggcgctgcaagcggtggccgcggccaccggggcgccgaccgcggcccatccgatcgacgccgacccgctgccggtcaaaccggaccggttgctcacccacggcgacagcgtgcgcatcggcgagctgacattcgacgtcatccacttgcgcggacacacacccggatcgatcgcgctggccctcggcgggccggtgaccggaggcgtcacacagctcttcaccggcgactgcttgttccccggcggtgtcggcaaaacctggcaacctgccgacttcacccaactgctcgacgacgtcaccacccgggttttcgacgtgtacgccgactccaccgtcatctaccccggccacggtgacgacacggagctgggtgccgaacgccccagcctcagcgaatggcgtgcgcgcggctggtaa

SEQ ID NO: 831 - DNA, 654 bp, Tuberculosis
gtgctaggcaggctgcgtggcggctatcaggtcgaaggccgcgaggttaccccgacccagctgctagagcgtctcgggttccgccgggaccagctgtccgcgcgagtcgacgacctctccggtggtcagcgtcggcggttgcagctcatgctgacgctgttgtccgagccgaacgtgctgctcctcgacgagcccaccaacgacgtggacaccgagatgctgacggcgaccgaagacctgcttgactcgtgggcgggtacgttgatcgtcgtctcacacgaccggtatctgctcgagcgggtcactgaccagcagtacgcgattctcgatgaccggttgcggcacctgcccggcggcatcgacgaatacctgcagctggctgcccgcgttagcgccccagcaccggccgagcggccagcgccgccggcgatgtcgggcgcacagcgacgtgccaccgaaaaagagttggccgcagtcgaccgtcaactcgcccgcctggccgaccgggtggccgccaaacataccgaactggccgagcatgaccagtccgaccacgtcggcatcacccggctgacccagcaactacgtgtcctgcaagaccacgtcgcggcgatggagaatcgctggctggagctttcggagatgctcgaatga

SEQ ID NO: 832 - DNA, 1332 bp, Tuberculosis
gtggcgacaatcgcggcaagccccacgcacaatgccctgggcaaggccgcgcgccggctgttgcccctgctgttcgtgttgtatgtgatcaacttcgttgatcgggccaacatctcggtcgcagccctggcgatgaacgccgacctgcgcctgagcgccaccgcatacggcaccgccgccggcgtcttcttcctcggctacgtcctgttccaggttcccgccaacgcggcgttggcgcgcttcggtgccggtcgaacgctcacggcggtcgtcctggcttggggtgtgtgctcggcggccacggccttggtcaccagcgcgcacaccttgtatctggcgcgcttcgccctcggcgtcgccgagggcggcttcttccccggcgtcatcgcgtatctgacggtgtggtttccgtgcgcgcagcgagcccgcgccgtagccacctttctgctggccattccggtcgccaacacggtcggcctgccgctgtctgggctgatcgtcggccacgttcacatggccgggctacccggctggcgggcaatgtttgtgatcgaggcattgcctgcactgctgctggcgccgcttcttcggcgcctgttgccggataacccgcaacgggcaagctggctcacccccgaggaacgtgcagagctgtcggcccggctgaccgaggacacccctgccccgaccggtcggtcgagtggagccggttgggatcttgtccttttcgctgtcgtctacgggggcctgtatttcgcgctgtatgcgttgcagttctttctgccccaactagttgcgtcgctggcacacggcaccgccacgctgaccgctgccacgttggcggccctgccgtacggtgtcgccgcgctggccatgttggcctggagccaccgcagcatcgaccgctcgggcgcccaagcgggccatatcacactgccaacaacggccgcgggcagcgccgcgctcggtgcggcattgagtccgatgtcaccgatagtgacgctgagttggctgaccatcgccgtcgccggaatccttgccgcgatgcccgctttctggagccgttgcaccgccgcgctggccggtccccgggtcgccgtggccatcgcgacggtcaatgccgtggccagtctggcgagcttcgccggtccctacgccaccggccacctcaaagacgccaccggcacttaccatctcgcgttgctgaccgtcgccgccgtacttgctgccgcggcggcttgtagcttgctactgcggcacgctggccggacagtatgcgccaacgactccgaaatcatgctgcacccgtcgccggcgaccccgttcgtctaa

SEQ ID NO: 833 - DNA, 735 bp, Tuberculosis
atggcagatcggtcggtgcgcccgctgcggcatctcgttcatgcggtgactgggggccaaccgccttccgaggcccaggtccgacaggcagcctggattgcgcggtgcgtcggtcgcggaggctcggcgccactgcaccgtgacgatgtgtcggcattggccgaaacgttacaagtcaaggagtttgcccccggggcagtggtattccacgccgatcaaaccgcggacggggtgtggattgtgcgacacggattaattgagctcgcggtcggctccaggcggcgccgcgccgtggtgaacatccttcatcccggcgatgtcgatggcgacatcccgctgctactggagatgccgatggtctacacggggcgcgccttgacccaagcgacctgcctgttcctggaccggcaggcgttcgagcggctgctagctacccacccggccatcgcacggcggtggctgtcgagtgtggcgcaacgggtgtcgactgcgcagattcggttaatgggcatgcttggccgcccgctgcccgcgcaggttgcgcagctcctgctcgacgaggcaatcgatgcccgtatcgaacttgcccaacgcaccctcgccgcaatgcttggagcgcagcgcccatcgatcaacaagattctcaaggagttcgagcgcgaccgattgatcaccgtcgggtatgcggtcatcgagatcaccgaccaacacggattacgcgcccgggctcaatga

SEQ ID NO: 834 - DNA, 768 bp, Tuberculosis
atgatgatttcatcaagtgatgaattacttcgcgacggtgccgaccccgcggtcatcatcgaccagctgcgcgtcatccgtggtaaacgccttgccctgcaggatgtttcggtccgggtcgcctgcggcacgatcaccggcctgctcggtccgtccgggtcgggcaagacaacactgattcgctgcatcgttggctcccaaatcattgcctcgggttcggtgagcgtgctgggccaaccggctgggtcagccgaactacgccatcgggttggatacatgcctcaggacccgaccatttacaacgacctgcgggtgatcgacaacatccgctacttcgccgaactctgcggcgtcgacaggcaagccgccgatgaggtgatcgaagcggtggacctgcgcgatcaccgcaccgcccgttgtgccaacctgtccggcggccagcgggcccgggtctcgctggcgtgtgcgctggtcggccggcctgatctgctagtgctcgacgagccgaccatcggcctggatccggtattgcgcgtcgaattatgggatcggttcacggcgctggcgcggcgtggcaccacgctgttggtgtccagccacgtaatggacgaggccgaccgctgcggcgatctgttgcttctgcgccaggggcagctgctggcccacacaacgccgcaccgtctacgaaaggaaaccggatgcacatcactggaggaagcgtttctgtccatcgtccgacgcaccaccaccgtgcccgcggccggctaa

SEQ ID NO: 835 - DNA, 624 bp, Tuberculosis
gtggctgagcatgatttcgagacgatatcgtcggaaaccttgcatacgggagccattttcgcattacgtcgggaccaggtgcggatgcctggtgggggtattgtgacgcgtgaggtcgtcgagcacttcggtgccgtagccattgtggcgatggacgacaacggcaacatcccgatggtttatcagtaccgccacacctatggtcggcggctttgggaactgcccgcggggttgctcgacgtcgctggggagccacctcatctcacggccgcccgggagctgcgggaggaggtcgggctgcaagccagcacctggcaggtgctggtcgatctggacaccgcgccgggcttcagcgacgaatcggtgcgggtctatctggccaccggactgcgcgaggtgggccggcccgaagcccatcacgaagaagccgacatgacgatggggtggtatcccattgccgaagcggctcgccgggtgctgcgtggcgaaatcgtcaattccattgccattgccggtgttttggccgtgcacgcggtgacgaccgggttcgcccagccacgcccactcgataccgaatggatcgacaggccaacggcgttcgccgcgcggagagccgagcgatga

SEQ ID NO: 836 - DNA, 570 bp, Tuberculosis
atggacctctattcaaacctcgtcgaagccgaacaacgcctggtcgcgctggtttcgtcgatagaagccgacagctactcctcgccgacgccgtgcgaccgctgggacgtgcgggcgctgctcagccacgcgctggcctcgatcgacgccttcgcggcggccgtcgacggagcacccggaccggacatggcgcaggtgttcagcggtgccgacatcgtcggggacgaccccctcggtgcgacgcagcggatcacccggcggtcgcaggcggcctggtcgaccgtgcgcgatctgaacgcggagctgtcgaccttcatcggcgtgatgccggcggggcaggctcttgcgatcatcaccttctccaccgtcgtccacggttgggacctagcggtggccacgggccaggccggcgaactcccggagcacctggccgaagcggcccaacaggtggcggccgaactggttcccgtcctgcgtccgcggggcctgttcgcacacgacgtcgacctagcgggggaagccacgcccactcagcggctcgtcgcccttaccggacggaaaccgcggtga

SEQ ID NO: 837 - DNA, 360 bp, Tuberculosis
atgtcggaccagccacgtcatcaccaggtcctcgacgacctgctgccccaacaccgcgctctacgtcaccagattccccaggtgtaccagcgatttgtagccctgggcgacgccgcgcttaccgacggcgctctcagccgcaaggtcaaggagcttgtggcgctggcgatcgcggttgtgcaggggtgcgatggctgcgtcgcatcacacgcccaagccgcggtacgggccggcgctacagcgcaagaagccgctgaggccatcggggtcaccatcttgatgcacggtggaccggccaccatccacggtgctcgtgcctacgcggcattttgcgaattcgctgacacaacgccgtcctag

SEQ ID NO: 838 - DNA, 1857 bp, Tuberculosis
atgtcctatctcgtcgtggtgccggagttggtcgcagcggcggcaacagatttggcgaacatcggttcgtcgattagtgcagccaacgcggccgcggcggcaccgaccacggcactggtcgcagccggcggcgacgaggtatcggcggccatagccgcgttgttcggagcgcatgctcgggcatatcaagcgttgagtgcccaggcggcgatgtttcatgaacagtttgtccgggccctcgccgccggcggtaactcctacgccgtcgctgaggcggcaaccgcgcaatcggttcagcaagatctgctcaacctgatcaatgcgcccacccaggcgctgttggggcgtccgctgatcggcaacggcgccaacgggctgccgggtacgggccagaacggcggcgacggcgggattctgtacggcaacggcggcaacggtgggtccggcggggtcaaccaggccggtggcaatggcgggaatgctgggctgtggggcaatggcggatccggcggagccggcgggaacgccaccactgccggccgcaacggcttcaacgggggcgccgggggaagcggcggtttgctgtggggcaatggcggtgccggcggggccggtgggaacggcggtccggctccgctcgtgggcggggtgggcaccaccggtggcgccggcgggaacggcggcggcgccgggttgttctacggtttcggcggcgccggtgggaacggcgggatgggcggggtggcaccgagcaccggcccctcgatgggcatcctcccggccggcggtgtcggcgggcctggtggctccggcggggcgagcgcgcttgccttcggctccggcggcgtcggcggtgccggtggcttgggcgggccgaccgatggcaccgtccagggggtgggcggcttcggcggtcagggcggcaacggcgggcagagcggcttgttgtttggcaacgcgggagccggcggggcaggcgctgccggcggagccggcaccggcgacaccgagagcttcggcggccacggcggggccggcggtgatggcggcgctgttggcttgatcggtaacggcggggccggcggcaccggatctcccggcgctgtggtgggtggtaacggcggcgtcggtggtctgggtggcgccggcagtcccgggggtctgttgtacggcaccgggggggccggcggcaatggcggaccgggtggtgacggtggtactggcgcgacggtgggctttgccggctccggcggtttcggcggtgcggggggcatcgcccagctgtttggcacgggtggcatgggtggtagcggcggtggtataggcgctggcaccacgaccgtggtgccgcccgacgtcgccccggtgggtggcacaggcggcaatggcggtcgcgccgggctgctgttgggtgtgggtggcatgggcggtaatggcggtgccaccagcgtcggcgggacgctctacgccgccggtggaaacggcggcgacggcgggttggtgtggggcaacggtggcaccggcgggagcggtggcgccggcggggcgggcagcgtcggcaacggcggtgcgggtggcaacgcggcactgctgttcggcaacggcggggcgggcggggccggcggcgccggcggcatcggtgccggcggagccggcggcttcggcgcggttctgtttggcaacggcggggctggcgggagcggtgcccccggtggcatcggcgccggtggcaatggcggaaacgcgctgctggtcggcaacggcggcaacggtggggcaggtaccggtggggctgctggcggtgccggtggctcgggcgggttgctattcggccaaaatgggatgcccgggccgtga

SEQ ID NO: 839 - DNA, 366 bp, Tuberculosis
atggggagcgatacggcctggagtccggcgcgcatgatcgggatcgcggcgctcgccgttggaatcgtgctgggtttggttttccatcccggcgtgccagaggtcatccagccgtatctgccgatcgcggtggtcgccgcgctcgacgcggtgttcggtggcttgcgcgcctatctcgagcggatctttgacccgaaggtcttcgtggtttcgttcgtgttcaacgttttggtggctgccctaatcgtctatgtcggtgaccaactgggcgtcggcacacagttgtccaccgcgatcatcgtcgtgctgggcatccgcatcttcggcaacaccgcggccttgcggcggcggttgttcggagcgtga

SEQ ID NO: 840 - DNA, 861 bp, Tuberculosis
atgagcatcgatttcacgccggatccgcagctgtacccgttcgagtcgcgctggttcgacagctcgcgtggacgcatccactacgtcgacgagggcacgggtccgccgatcctgttgtgtcacggcaacccgacgtggagtttcctgtatcgggacatcatcgtcgcactgcgggaccgtttccgttgtgtggctccggattatctgggtttcgggttatcggagcgtccctcgggattcgggtaccagatcgacgagcacgcgcgggtgatcggcgaattcgtcgatcacctgggcctggaccgctacctgagcatgggtcaggactggggtggcccgatcagcatggcggtcgctgtcgagcgtgccgaccgggtccgcggcgtcgtgttgggcaacacgtggttctggccggcggacacgctggcgatgaaggccttcagcagggtgatgtccagcccgccagtgcagtacgcgatcttacggcgcaacttctttgtcgagcgcttgatacccgcgggaaccgagcaccggccgagtagcgcggtgatggcgcactaccgggcggtgcagcccaacgccgcggcacgccgaggcgtagccgagatgcccaaacagatcctggccgcccgtcccctgctggcacggctcgcccgggaggtgccagccacgctgggcaccaagcccaccctgttgatttgggggatgaaggatgtcgcattcaggccgaaaacgattatccccagactgagtgcgacatttcccgaccacgtcctggtggagctgcccaacgccaaacacttcatccaggaggacgcccccgaccggatcgccgccgcgatcattgagcgcttcggctga

SEQ ID NO: 841 - DNA, 423 bp, Tuberculosis
gtgcagccatcgccggactcacccgctccgctgaatgtcaccgtgccgttcgacagcgagttgggtttgcaattcaccgaactgggtcccgacggggcccgagcgcagctcgacgtccggcccaagttgttgcagctgacgggcgtcgtgcacggcggtgtctactgcgcgatgatcgagagcatcgccagcatggcagcctttgcctggctcaattcgcacggcgaaggcgggagtgtggtcggcgttaacaataatacggatttcgtgcgctccatcagctcagggatggtgtatggcaccgccgaaccgctgcatcggggtcggcggcaacagctgtggctggtcaccatcaccgacgacaccgaccgggtggtcgcccgcggccaagtgcggctgcagaacctcgaggcgcggccttaa

SEQ ID NO: 842 - DNA, 978 bp, Tuberculosis
atgcatcaggtggaccccaacttgacacgtcgcaagggacgattggcggcactggctatcgcggcgatggccagcgccagcctggtgaccgttgcggtgcccgcgaccgccaacgccgatccggagccagcgcccccggtacccacaacggccgcctcgccgccgtcgaccgctgcagcgccacccgcaccggcgacacctgttgcccccccaccaccggccgccgccaacacgccgaatgcccagccgggcgatcccaacgcagcacctccgccggccgacccgaacgcaccgccgccacctgtcattgccccaaacgcaccccaacctgtccggatcgacaacccggttggaggattcagcttcgcgctgcctgctggctgggtggagtctgacgccgcccacttcgactacggttcagcactcctcagcaaaaccaccggggacccgccatttcccggacagccgccgccggtggccaatgacacccgtatcgtgctcggccggctagaccaaaagctttacgccagcgccgaagccaccgactccaaggccgcggcccggttgggctcggacatgggtgagttctatatgccctacccgggcacccggatcaaccaggaaaccgtctcgctcgacgccaacggggtgtctggaagcgcgtcgtattacgaagtcaagttcagcgatccgagtaagccgaacggccagatctggacgggcgtaatcggctcgcccgcggcgaacgcaccggacgccgggccccctcagcgctggtttgtggtatggctcgggaccgccaacaacccggtggacaagggcgcggccaaggcgctggccgaatcgatccggcctttggtcgccccgccgccggcgccggcaccggctcctgcagagcccgctccggcgccggcgccggccggggaagtcgctcctaccccgacgacaccgacaccgcagcggaccttaccggcctga

SEQ ID NO: 843 - DNA, 438 bp, Tuberculosis
atgaagtcagcaagcgacccgttcgacctgaagcgtttcgtgtacgcgcaggctccggtctaccgcagcgtcgtcgaggagctgcgcgccggacgaaagcgcggtcattggatgtggttcgtcttcccacaactccgcgggctaggtagtagcccactggcagtgcgctacggcatctcctcgctcgaggaagcccaggcctatctgcagcatgacctgctcgggccccgcttgcatgagtgcaccgggttggtcaaccaggtgcaaggccgctcaatcgaggaaatcttcggcccgcccgacgacctcaagctgtgctcgtcgatgaccctgttcgcccgtgccaccgacgccaaccaggactttgtcgcgctgctcgccaagtattacggcggcggagaggaccggcggacggtggcattactggcggtcacatag

SEQ ID NO: 844 - DNA, 561 bp, Tuberculosis
atgcaacctgacgcctatccagtccgggtccggggtgacctcgatcctgcgttgtcacgttggcagtggctagtcaagtggtttttggccatcccgcactacattgtcttgttcttcttgcacgttgccgccgtggtggtcaccgtgatcgcgttctttgccatcctgttcacgggcagatatccccggacgctgttcgacttcaatgtcggcgtcatgcggtggcgctggcgggttgccttctatgcgctgtcggcgctgggaaccgaccggtacccgcccttcagcctgcagacaaaggcggagtatccggctgacttggaggttgactatccggagcggttgagccgcggcctggtgctgattaagtggtggctacttgctatcccccactacctgatcctggcggtcttcctctccagcggttggcgagtcttcctgatcgacccccacgaccgcgtcggcataatgtggccttcgctactggtgatcctgctgctcgtcgccgtggtggcgctcctgttcaccggccggtaccccatagggctatacaacctgtaa

SEQ ID NO: 845 - DNA, 309 bp, Tuberculosis
gtgtctgtgctggtcgcgttttccgtcaccccgctgggcgtgggggagggggtcggcgagatcgtcaccgaagcgattcgcgtggtccgtgattccggcctgccgaaccagacagatgccatgttcaccgtgatcgaaggcgatacctgggcggaagtgatggccgtcgtgcagcgcgcggtggaggccgtggccgctcgggcaccgcgagtcagcgcggtgatcaaggtggactggcgtcccggggtcaccgacgcgatgacccagaaggtcgctaccgtcgagcggtatcttctccggcctgaatag

SEQ ID NO: 846 - DNA, 864 bp, Tuberculosis
gtgttcccgcgctggccgcagcaggcgcataatcacgaggtgtcccgcgcagataccgtctcagtgccccgtgcgcccacccaggctgaggtcgccgcagtgctgcgcatcatgacgccgctgcgcaaggtgattaaaccaaaggtctatgggatcgaaaatgtgccgaccgaacgcgcattgctggttggcaaccacaacacgcttggcttggtcgacgcgccattgctggccgccgagctctgggagcgggggagaatcgtccggtcccttggcgaccacgcccatttcaagattccggggtggcgcgacgcgctgacacgaacaggggtcgtcgaaggcaccagagagatcacctcggagttgatgcgacgcggcgagctcgtcatggtctttcccggcggcgcccgtgaggtcaacaagcgcaagaacgagcgctacaagctggtgtggaaaaatcggctggggttcgcgcgcttggcaattcagcacggctatccgattgtgccgttcgcttcggtgggtgctgaacacggcatcgacatcgtgctcgacaacgaatccccactgctggcaccggtccagttcctcgccgagaagctgctcggcaccaaagacggtccggcgctggtccgtggtgtcggactgacaccggtaccgcgccccgaacggcagtattactggttcggcgagccaatcgacaccacagagtttatggggcagcaagccgacgataacgccgcacgcagggtgcgcgagcgtgccgccgccgctatcgaacacggcatcgagctgatgctggccgagcgcgcagccgatccaaatcgatccctggtcggacggctcttgcgctcggacgcctaa

SEQ ID NO: 847 - DNA, 522 bp, Tuberculosis
atggcggctggatcagggggcggcacagttggtcttgtcctgcctcgagtggcgtcgttgtccggcttggacggggctccgacggtaccggagggcagcgacaaagcacttatgcacttgggcgacccgccgagacggtgcgacacccatcccgacggcacaagctcagccgcggccgctcttgttcttcgtcggatcgacgttcacccacttctgaccgggcttgggcgagggaggcagacggtgtcccttcggaacggtcacctcgttgccaccgccaaccgggcgatactgtcccgacgtcggagccggcttacccggggacgtagctttacgagccatctgatcacctcctgtcccagactcgatgaccaccagcaccggcatcccacccgctgtcgcgcggaacacgccgggtgtacagtcgcaacctgcatccccaatgcacacgaccctgcccctggccatcagaccccgaggtggggtccttttcgtctaaaaccagcttataccagaatatag

SEQ ID NO: 848 - DNA, 297 bp, Tuberculosis
gtgagtagccgataccttctctcgcctgccgcgcaggcacatctggaagagatctgggactgcacctatgaccgttggggtgtcgatcaggccgagcagtacctgcgcgaacttcaacacgctatcgaccgtgctgcggcaaacccgcggatcggacgagcgtgcgacgagattcgccccggctatcgcaagctctcggccgggtcacacacgttgttctatcgggtgactggcgaaggcaccatcgacgtcgtgcgagtcctgcaccaacggatggacgtcgaccggaacctctga

SEQ ID NO: 849 - DNA, 798 bp, Tuberculosis
atggtaatcgtggccgacaaggcggccggtcgggtcgctgatccggtcttgcggccggtgggcgcgctgggcgatttcttcgcgatgacgctcgacacgtccgtgtgcatgttcaagccgcctttcgcgtggcgtgaatacctacttcagtgctggttcgtggcgcgggtgtcgacgctgcctggggtgttgatgacgatcccatgggcggtgatctcggggtttctcttcaacgtcttgctgaccgacatcggtgccgcggacttttccggcaccggctgtgcgatcttcaccgtgaaccaaagcgccccgatcgtcacggtcttggtggtcgcgggcgcgggcgccaccgccatgtgcgccgatctgggtgcgcgcaccatccgtgaggaactcgacgcactgcgggtgatgggcatcaacccgatccaagcgctagcggctccgcgcgtgctggcggccaccacggtgtcgttggcgctgaattcggtggtgaccgcgacggggctgatcggcgcgttcttttgctcggtgtttctcatgcacgtctcggcgggggcatgggtgaccgggcttaccacgctgacccacaccgtggacgtcgtcatttcgatgatcaaggcgacgttgttcgggctgatggccggactgatcgcctgctataagggcatgtcggtcggtggcggcccggccggagtcggccgggcggtgaacgaaaccgtggtgtttgccttcatcgtcttgttcgtgatcaacatcgtcgtcaccgcggtcggcatcccattcatggtgtcctga

SEQ ID NO: 850 - DNA, 654 bp, Tuberculosis
atgactccacgcagccttgttcgcatcgttggtgtcgtggttgcgacgaccttggcgctggtgagcgcacccgccggcggtcgtgccgcgcatgcggatccgtgttcggacatcgcggtcgttttcgctcgcggcacgcatcaggcttctggtcttggcgacgtcggtgaggcgttcgtcgactcgcttacctcgcaagttggcgggcggtcgattggggtctacgcggtgaactacccagcaagcgacgactaccgcgcgagcgcgtcaaacggttccgatgatgcgagcgcccacatccagcgcaccgtcgccagctgcccgaacaccaggattgtgcttggtggctattcgcagggtgcgacggtcatcgatttgtccacctcggcgatgccgcccgcggtggcagatcatgtcgccgctgtcgcccttttcggcgagccatccagtggtttctccagcatgttgtggggcggcgggtcgttgccgacaatcggtccgctgtatagctctaagaccataaacttgtgtgctcccgacgatccaatatgcaccggaggcggcaatattatggcgcatgtttcgtatgttcagtcggggatgacaagccaggcggcgacattcgcggcgaacaggctcgatcacgccggatga

SEQ ID NO: 851 - DNA, 540 bp, Tuberculosis
gtgtccgccctcggacggtcgcgacgggcatggggctggcaccggctccatgacgaatgggcagcgcgggtagtcagcgcggccgcagtgcggcccggtgagctcgtgtttgacatcggcgccggcgaaggggcactgacggcgcatctagtgcgagcgggggcgcgggtggtcgccgtggagttgcacccgcgacgagtcggtgtcctccgcgagcgattccctggcattaccgtggtgcacgcggacgccgcctcgatccggttgcccggccggccgttccgggttgtggcgaacccgccgtacgggatttcgtcccgcctgctgcggacgctgctggcacccaacagcgggcttgtcgcggccgatctcgtgctgcagcgagccctcgtatgtaaattcgcttctcgcaacgcgcgaaggttcaccctgaccgtcggcctcatgctgccacggcgcgcgttcctgccaccgccgcatgtggattccgcggtgctcgtcgtccgccgccggaagtgcggtgactggcaggggcggtaa

SEQ ID NO: 852 - DNA, 753 bp, Tuberculosis
gtgcaccataaccgcgatgtcgacttggcgcttgtcgagcgacccagctcgggatacgtctacacaacgggttggcgactggccacaacggacatcgacgagcaccaacaactgcgcctcgacggtgtggcgcgctatatccaagaggtcggtgccgagcatctcgccgatgcccaattggcagaggtccatccccattggattgtcctgcgcacggtcatcgatgtcatcaacccgattgagctacccagcgacatcacctttcaccggtggtgcgcagcgctttccaccaggtggtgcagcatgcgtgtgcagctgcaaggatccgccggcggccgcatcgaaaccgaagggttctggatctgcgtgaacaaagacaccctgacgccgtcccgtctcaccgatgactgcatcgcacgtttcggcagcaccaccgaaaaccaccggctcaagtggcgcccatggctcaccgggccgaacatcgatggtaccgagacaccatttcccttgcgtcgcacggatattgacccgttcgagcatgtcaacaacaccatctactggcacggtgtgcacgaaatactctgccagatacccaccctgacggcaccctaccgcgccgtgctcgagtaccgcagccccatcaagtccggcgaaccgctgaccattcgttacgagcagcacgacgacgtcgtgcgcatgcacttcgtcgtcggcgacgacgtgcgcgcggcagcgctgctgcgcaggctataa

SEQ ID NO: 853 - DNA, 432 bp, Tuberculosis
atgtccgatgagatcgctcggctggtagcagacgtattcgagctcgctggcctgctacggcgctcaggtgaggtggtcgctgccagagaggggcacacgcaggcgcgatggcagctgctgagcgtggtctccgatcgagcgctgaccgtgccccaagccgctcgccgccttggtgttacccgtcagggggtgcagcgagtggccaacgatctggtcgtttgcggcttggccgagctcagacacaaccccgaccaccgcacatcaccactgctggtgctaaccgagaatggtcgccgcgttctccaggcaatcaccgaacgcgccatcgtcgtcaacaaccgacttgctgacgccgtagacccggccgcgctgcaagcgacccgcgacagcctgaggcggatgatcgtcgcgctgaaagccgaacgtccttga

SEQ ID NO: 854 - DNA, 843 bp, Tuberculosis
gtgctggatcgctatggaaccgacgtgcttgccgcaggcgggcggcgccggccccgctcggttgagcacccggtcgagctcggcatggtcgtcgaagacgccgagaccggctacgtcggtgcggtggtccgagtcgaatatggccgcatcgacttggaagaccgctacgggaagacccgcgggtttccgctgggccccgggtatctactcgacggcctgccggtgatcctcaccgcgccgcggtgcgcagcggctgccggcccgaggcgaacggcatccggctcggtcgcggtgccgggcgcgcgtgcccgggtggcccgggccagccggatctatgtcgagggccgacacgacgctgaactcatcgcggcggtatggggagcggacctgcgaatcgaaggtgtcgtcgtcgaacatctcggtggcgtcgacgacctggtggagatcgtcgccaagttccggcccggcccgcggcgtcggctcggcgttctcgttgaccatttggtcgcggggtcgaaagaggcgcgcatcgccgaggtggtgcgccgcggaccgggcggctccgacactttggtcgtcgggcacccctacgtcgacatttggcaggcggtcaagccacaacgagttgggctggccgcctggccgagggtgccgcggcacatcgagtggaagcacggcgtgtgcgatgcgctcggctggccgcacgccgaccaggccgacatcgccgcggcgtggcggcgcatccgttcgcaagtacgcgactggaccgacctagagccggcgttgatcggccgggtggaagaactgatcgacttcgtcactcagccggccggggacgaatag

SEQ ID NO: 855 - DNA, 657 bp, Tuberculosis
atgcggatcgccgcgctggtcgcagtgtcgttgctgattgcggggtgctcgcgcgaggtcggcggtgatgtagggcagtcgcagaccatcgccccgccggcgcccgccccgtcggcggcgccgtcaacaccaccggccgcaggagcgccgatcaccactatcgtgtcttggattgaggcgggtcacccggttgatcccgccgcctatcacgtcgccacccgcgacggcgtcaccacccagcttggcgacgacgtcgcgttcagcgcttcgtcgggcacggtggcctgtatgacggatgccaggcacactagcggcaccctggcctgcctggtccgactcgcgaacccaccaccccggcccgagacggcctacggcgaatggaagggcggctgggtcgactttgacggcatccacctgcaggtcgggtccgcccgcgccgacccgggcccgttcgtctacggcaatggacccgagctggccaacggggacacgctgtcgatcggggactaccgctgccgctcctatcaagcgggcctgttctgcgtgaactacgcccatcagtccgcggtccggttcgccagcgccgggatcgagccgttcggctgcctgaagccggcgccgccacccgacggcgtgggcgttgcgttcggctgctga

SEQ ID NO: 856 - DNA, 558 bp, Tuberculosis
atgaccgcgacggcaagcgacgacgaggccgttaccgcactcgccttgtcggcggccaaggggaacgggcgggcccttgaggcgtttatcaaagccacccagcaagacgtgtggcggttcgtcgcctatctgtccgacgtgggcagtgcggacgatctcacccaagagacattcctacgagcgatcggcgccatcccgcggttttccgcacgctccagcgcccgaacttggttgctggccatcgcgcgccatgtcgtcgccgatcacatccgccacgtccgatcccggccccgcaccacccgcggcgcgcgtcccgaacatctcatagacggcgaccgccatgcccgcggattcgaagacctcgtcgaggtaaccacgatgatcgccgacctaaccaccgaccaacgggaagcgctgctgctgacccagctgctcgggctgtcctatgcggacgccgcggcggtgtgcggctgcccggtgggcaccatccgatcccgtgtcgctcgagcgcgcgatgcgctgcttgccgacgcggagcccgacgacctcaccggctag

SEQ ID NO: 857 - DNA, 750 bp, Tuberculosis
gtggacgacacgggcgctgctccggtagtaattttcggcggccgcagccagatcggcggcgaactcgcgcgacgcctggctgccggggcgacgatggtgctggccgcgcggaacgccgatcaactcgccgaccaggccgccgcactccgcgcagctggcgctatagcggtgcacacccgggagttcgacgccgacgacctggccgcacacggcccgttggtcgcttcgctcgttgccgagcacggccccatcggcaccgcggtgctggccttcgggatactcggcgaccaggcccgcgccgagacagacgcggcgcacgcggtggccatcgtgcacaccgactacgtcgcccaggtcagcctgctgactcatctggcagcggcgatgcgcaccgccggacggggatcgctggtggtgttctcctcggtcgccgggattcgggtgcgccgcgccaactatgtctacggatcggccaaagccggcctggacggcttcgccagcggcctggccgatgcgttgcacggcaccggggtgcggttactgatcgcgcggccgggattcgtcatcgggcgcatgaccgagggcatgacgcccgcacccctgtcggtcaccccggagcgggtggccgccgcgaccgcgcgtgcgctggtcaacggtaagcgcgtggtgtggattccgtgggcgctgcggccaatgtttgttgcgctgcggttgcttccccggttcgtctggcgcaggatgccgcgatga

SEQ ID NO: 858 - DNA, 972 bp, Tuberculosis
atgctggccaccctgtcccaaatccgggcatggagcaccgagcaccttatcgatgcggccggctactggaccgaaaccgcggatcggtgggaagacgtgtttctgcagatgcgaaaccaggcccatgccatcgcctggaatggcgccgggggcgacgggctgcgacaacgaacccgagctgacttctcaacggtcagtggcatagccgaccagctgcggagagcagccacgatcgcgcgcaacggcgccggcactatcgacgcggcacaacgaagagttatgtatgctgtagaggacgcccaggacgccggtttcaacgtcggtgaagacctatcggtcaccgacaccaaaacgacgcagccggctgcagtgcaggccgctcgactagctcaggctcaggcgttggccggtgacatccgcttacgtgtcgggcaactggttgcggcggagaacgaggtgtccggtcagctcgccgcgaccaccggtgatgtgggaaatgtccgcttcgcgggcgccccggttgttgcccacagcgcggttcagctagtcgacttcttcaaacaagacggcccaacacctccaccgccaggagcgccacacccgtccggtggagccgacggaccgtactccgatccgatcacttcaatgatgctgccaccggccgggacagaggcacccgtatcagacgcgaccaaacggtgggtggacaacatggtcaacgagctggccgctaggccgccggatgaccccatcgcggtggaggcgcgccggctggcgtttcaagctctgcaccggccatgtaacagcgcggagtggacggcggctgttgcgggtttcgcaggatcatcggctggcgtagttgggaccgccctagcaattccggccggccctgccgactgggcactacttggcgccgccttactgggggttggcggatcgggagcggcggtggtcaactgtgccaccaagtag

SEQ ID NO: 859 - DNA, 1305 bp, Tuberculosis
ggccagagctatcaagcggtcagcgcccaggcggcggcgtttcatgaccggttcgtccaactgcttaacgccggtggaggttcatatgcgagcgccgagattgccaacgcgcagcagaacctgctgaacgcggtgaacgcgcccacccagacgctgctggggcgtccgctggtcggcgacggcgccgacggggccagtggtccggtgggacagcccggcggggacggcggcatcttgtggggcaacggcggcaacggtggcgacagcacgagccccggggttgccgggggagccggcgggtcagcggggctgatcggcaacggcggcaggggcggcaacggtgcgcccggcggtgcaggaggcaatggcggcctgggcggattgctgctgggcaacgggggtgccgggggagtcggcggtaccggtgacaacggtgtgggagacctcggtgctggcggcgggggaggcgatggcggtttgggtggacgggcggggctgatcggtcacggcggtgccggcggaaacggtggggacggtgggcacggcgggagcggcaaggccggcggcagtggcggcagtggcggcttcggccagttcggtggcgccggcgggctgctgtacggcaatggaggggcggccggttccggcggcaacggtggcgatgcaggtaccggcgtctccagcgacggtttcgccgggttgggcggcagcggtggccggggcggcgacgcggggctgattggtgtcggcggcggcggcggcggcaacggcggcgacccagggctcggtgcgcgcctgttccaggtaggtagtcgcggcggcgacggtggggtcggcgggtggctgtacggcgatggcggcggcggcggcgacggcggtaatggggggctgccatttattggctccaccaacgccggcaacggcggcagcgcgcggctcatcggcaacggtggtgccggcggtagcggcgggagcggcgcgcctggctcggtcagcagcggtggcgtcgggggcgcgggcaaccccggcggcagcggtggcaacggcggcgtgtggtacggcaacggtggcgccggcggggccgccggccaaggggggcccggcatgaacaccacctcgcccggcgggccgggcggtgtcggcgggcacggcggcaccgccatcttgttcggcgacggtggcgccggtggggctggcgccgccggcggacccggtactccggacggggccgcggggcccggcggcagcggcggcaccggcgggctgctgttcggagtccccggcccgtccggcccggacgggtaa

SEQ ID NO: 860 - DNA, 717 bp, Tuberculosis
gtgctggaggacatcggcctgggtaaccggctgcagcgtggccgcagctatgcgcgcaaggggcaggtgatctcgctgcaggtggatgccggcttggtcaccgcgctggtgcagggcagccgggcccggccgtaccggatccgcatcgggattccggcgttcggcaagtcgcaatgggcgcacgtcgagcgaaccctggccgaaaacgcttggtacgcagcaaaattgctgtccggcgaaatgcccgaagacatcgaggacgtcttcgccggcctgggcctgtcgctattccccggcaccgcccgagagctatcactggactgctcctgccccgactacgcggtcccatgcaagcacctggccgccaccttctacttgctggccgagtccttcgacgaggatccgttcgccatcctggcgtggcgtggccgcgagcgggaggatctgctggccaacctggccgctgcccgcgccgacggagcggcaccggccgccgaccacgccgaacaagtggcccagccgctcaccgactgcctagaccgctattacgcccggcaggccgacatcaatgtccccagcccgccggcaaccccatcgacggcattgctcgaccagctgcccgacaccggactcagcgcccgcggacggccgctgaccgagctcctgcgacccgcctatcacgccctgacgcaccatcacaacagcgcgggcggctga

SEQ ID NO: 861 - DNA, 624 bp, Tuberculosis
atgtcggctcccgaacgggtaaccggcttgtccgggcaacgttacggggaagtccttctcgtaacacccggggaggccggtccacaggccaccgtttacaacagcttcccgcttaacgattgtccggccgagctgtggtccgcgctcgatccgcaagccctagccaccgaacacaaagcggccaccgccctgctcaacggtccgcgctattggttgatgaacgccatcgagaaggcgccccagggcccgccggtgacgaagaccttcggcgggatcgagatgctccagcaggccacggtgctgctgtcatcgatgaaccctgccccatacaccgtcagccaggtcagccgcaacacggtctttgtgttcaacgccggcgaagaggtctacgaactgcaggaccccaagggacagcgctgggtgatgcagacgtggagtcaagtggtggaccccaacctgtcccgagccgacctgcccaagctgggtgaacggctcaacctgccagccgggtggtcctatcatacccgcgtgcttaccagcgagttgcgggtcgacactaccaaccgggaggcccgcgtcctgcaagacgacctcaccaacagctactcgctggtgaccgcctga

SEQ ID NO: 862 - DNA, 831 bp, Tuberculosis
atgtcttggtggcaagtcatcgtgttggccgcggcccagggtttgaccgagttcctgccggtgtcgtcctcgggacatctggcgatcgtgtcgcggatcttcttcagcggcgacgccggtgcctcgttcaccgccgtgagccagttgggcaccgaggccgccgtagtgatctactttgcgcgcgatattgtgcgcatcctgagcgcttggttgcacggcctggtcgtgaaggcacatcgaaacaccgattatcggctgggctggtatgtcatcatcggcacaatcccgatctgcattctgggcctgttcttcaaagacgacatccggtcgggcgtccgcaacctgtgggtcgtggtgaccgcgctggtggtgttttccggggtgatcgcactcgccgaatacgtggggcgccagagtcgtcacattgagcggttgacctggcgggatgccgtggtggttggtattgcccaaaccctggcgctggtccccggggtatccaggtccgggtcgaccatcagcgctggactgtttctcggactcgaccgtgaactggccgcccgattcggattcctgctggccattccagcggtgttcgcctccgggttgttctcgttgcccgacgcattccacccggtaaccgagggcatgagcgctactggcccgcagttgctggtggccaccctgatcgcgttcgtcctcggtctgaccgcggtggcctggctgctgcggtttctggtgcgacacaacatgtactggttcgtcggctaccgggtgctcgtcgggacgggcatgctcgtgctgctggctaccgggacggtagccgcgacatga

SEQ ID NO: 863 - DNA, 1599 bp, Tuberculosis
atgtcgtttgtgattgcggcgccggaggtgatggcagcggccgccacggatttggcgaacatcgggtcgtcgatcagcgccgccagtgcggcggcggcaggccccacgatgggaatcctggcggccggcgccgacgaggtgtcggtggcgatctcggcgttgttcgggtcgcacgcccagggctatcagacgttgagcgctcagctggcggcgtatcacaaccagttcgtgcgggccctgaacgccggcgcgggctcgtatgccagcgccgaggccgccaacgtgcagcagaccctgctcaacgcgatcaacgcgcccacccaaacgttgctggggcgcccgttgatcggcaacggcgccgacgggggtcccgggcaaaacggtgggcccggcggcttgttgtacggcaacggtggtaacggcggggccggtgacaccgccaatcccaacggcggcaacggcggatcggcggggctgatcggcaacggcggggccggaggcgcgggtgcggccaccggagcgggaggtgcgggcggcaatggcggatggctgtacggcaacggggggcccgggggtgcggccgggctcggcaccgccgggggcgtcagccccgccggcggggccggcggggccgccgggctgtggggccatggcggggccggcggggccggcggcagcgcatccggggcaccgggggccggcggcgccggtggtgacggagggcgcggcgggctgctgtacggcgacggcggggccggcggggctggtgggaacggaagcaacggggtgaccggggtgcacggcggaaacggcggtgccggcggcgccgccgggctgatcggcaacggtggcgccggcggtgacggcggtaacggcgggctcagcaacaccggcgccagcggtggggcgggtggtgccggcggggccgccctgatcggtaatggcggcgacggggggcacggcggcaacggtggccacggcaacagcggtggggccggcggcgccggtggggccggtggggccggtggggccggtgggcacgtcgggctgatcggcaacggcggcaacggcggtgccggcggcaacgggggcaacgacaacagctccacccttgccgatgcggggtccggcggcgccggcgcggccggcggcaacggcgggctgttctacggcaacggcggcgtcggcgggcgcggcggcaacggcggcttctcgtcggccggcaccagcggcggggacggcggcatcggcggtgccggcgggatcggcgggctgatcggcagcggcggcggcggcggggacggcggcaacggcggacaggctcccacgccgggtaatgccggtgacggcggcgccggcggcaacgccaggctgatcggtgacggcgggcgcggcggcaacggcggggaaggcggcgacggccccccaggcgttaaaggcgacggtggtaacgggggcaacggcggcaacgccgtggtgatcggcaacggcggcaacggcggggccggcggcttcggcatacccgtcggaagtggtggtgccggcggcagccgtggtgtgctgttcggcacccctggagcaaacggcgccgacggctga

SEQ ID NO: 864 - DNA, 1155 bp, Tuberculosis
atgagggccaagcgtgaggcaccgaaaagccgcagcagcgatcgtcgcaggagagccgacagtcctgccgcggcgacgaggcgaacgactacgaactcggcgccgtcgcgccgcatccggagccgtgccggcaagacctcggcacccggccggcaggcccgggtgtcgcgccctggaccgcaaaccagcccgatgctcagcccgttcgaccggccggcccccgcaaagaacaccagccaggccaaggcgcgggccaaggcccgaaaagccaaggcgcccaagctggtccgtcctacgccgatggagcgtctcgccgcccggctcacgtcgatcgacctgcggccgcgcacgttggcaaacaaggttccgtttgtggtgctggttatcggttcgctcggcgtcggactaggcctcacactgtggttgtccaccgatgccgccgagaggtcctaccagctgagcaacgcccgggagcggacccggatgctgcagcagcacaaggaagcgctggaacgcgacgtacgcgaggctgcgtcggcgccggcgctggccgaggcggctcgtcgccagggcatgatcccgacgagggataccgcccacctggttcaggatccggacggcaattgggtggtggtcggtacacccaagccggctgacggagttccaccgccgccgctgaacacgaagttgcccgaagatccgccgccgcccccgaaacccgcggcggtgcccctcgaggtgccggtccgggtgacaccaggccccgatgatcccgctccgcccgcccggtctggcccggaggtgctggtgcgtaccccagacggcacagcgacgctgggcggcgcaacccacctgcccacccaggccggcccgcagctgcccggtccggtgccgatacctggggcgccgggtccgatgccggctcctccgctcggcgcagtgccatccccggcaccagcggaaaatccggtgccgctccaggtgggtgcggcgcccccggccgggctccctggaccagcaccggtggctgcgacgcccgggctgtcgggtgggtcgcaacccatggtggcaccacccgctccagtgccggccaacggcgaacagttcggtcccgtcacggcgccggtgccaacggcgccgggggctcccaggtga

SEQ ID NO: 865 - DNA, 432 bp, Tuberculosis
atgtttctcggcacctacacgcccaaactcgacgacaaggggcggctgacgctgccggccaagtttcgcgacgcgttggcaggggggttgatggtcaccaagagccaagatcacagcctggccgtttacccgcgggcggcgttcgagcagctggcgcgccgggccagcaaggcgccacgaagcaaccccgaggcgagagcgttcctacgtaatctcgccgccggtaccgacgaacagcatcccgacagtcaaggccggatcaccttgtcggccgaccaccgccgctacgcaagcctttccaaggactgtgtggtgatcggcgcggtcgactatctcgagatctgggatgcgcaagcctggcagaactaccaacaaatccatgaagagaacttctccgcggccagcgatgaagcactcggtgacatcttctga

SEQ ID NO: 866 - DNA, 744 bp, Tuberculosis
atgtggtactacctgttcaagtacattttcatgggtccgctctttacgttgcttggtcgcccgaaagttgaaggactggaatacatcccgagttcgggtccggccatcctcgccagtaaccatcttgcggtggcggatagcttctaccttccgttggtagttcgccgtcgtatctggttcctggcgaaatcggaatacttcaccggcaccggactgaaaggctggatcaaccgctggttctacagcgtctccggccaggttcccatcgaccgcaccaatgccgactccgcgcagggcgcactgcagacggcagtggtgttgctgggtcagggcaagctgctgggcatgtatccagaaggcactcgctcgccggacggtcggctctacaaaggcaagaccggcctagcccggttggcattgcacaccggggttccggtgattccggtggcgatgatcggtaccaacgtcgtcaacccgccgggcaggaagatgctgaggttcggcagggtcaccgttcggtttggcaagccgatggacttctcccggttcgaggggttggccggtaaccatttcatcgagcgggccgttaccgacgaagtgatctatgagctgatggggctctcgggtcaggagtacgtcgacatctatgccgccagtgtcaaagacggccgcaacgcgggcggtgccggtgcaaatcccaattcaacggacgccgcacgaatccccgagacagccgctggctag

SEQ ID NO: 867 - DNA, 357 bp, Tuberculosis
atgacggtgcagaacgagccgagcgccaagacccacggcgtgatcctgaccgaagcggccgccgccaaggcgaagtcgctgttggaccaggagggacgggacgatctggcgctgcggatcgcggttcagccgggggggtgcgctggattgcgctataaccttttcttcgacgaccggacgctggatggtgaccaaaccgcggagttcggtggtgtcaggttgatcgtggaccggatgagcgcgccgtatgtggaaggcgcgtcgatcgatttcgtcgacactattgagaagcaaggcttcaccatcgacaatcccaacgccaccggctcctgcgcgtgcggggattcgttcaactga

SEQ ID NO: 868 - DNA, 750 bp, Tuberculosis
gtgatgcgttcgctggcaacagctttcgcattcgcaacggtgatacccacaccgggctcagcgaccaccccgatgggccgtggcccgatgaccgcgctgccggtggtgggcgcggcgctgggtgcactggcggcggcgatcgcatgggctggcgcgcaagtgttcggcccgtccagcccgctgtccggcatgctcacggtggcggtactgctggtcgtcactcgaggcctgcacatcgatggcgttgccgataccgctgacggactgggctgctatgggccgccgcagcgtgcgcttgcggtgatgcgcgacgggtcgaccggaccgttcggggtggcggccgtggtcttggtcatcgccttgcagggcctggccttcgcgaccctcaccacggtcgggatcgctgggatcacgctggcggtcttatccggccgggtcaccgccgtactggtctgtcgccggttggtgccggcagcccacggcagcaccctgggctcgcgggtcgccggtacgcaacccgcgccggtggtggcggcctggctcgccgtcctgctcgccgtttcggtgccggccggtccccggccttggcaaggaccgatagcggttctggtagcggtgacggccggcgcggccctggcggcgcattgcgtgcaccggttcggcggtgtcaccggtgacgtgctgggcagcgcgatcgagctgagcacgacggtcagcgccgtgacgcttgcgggcttggcccggctttag

SEQ ID NO: 869 - DNA, 1140 bp, Tuberculosis
atgagtgtgcggctggccgatgtcatcgacgtgctggaccaggcctacccgccgcggcttgcccagtcgtgggattcggtgggtctggtgtgcggcgaccccgacgacgtggtggattcggtgaccgttgcggtggacgcgacgccggcggtggtggaccaggttccccaggccggactgctattggtgcaccacccgttgttactgcgtggggtcgatacggtcgcggccaacacgccaaagggtgtgctggtgcaccgcctgatccggaccggtcgctcgttgtttaccgcgcacaccaacgccgactcggcgtcgccgggtgtgtccgacgcgctggcacacgctgttggtctgaccgtcgacgccgttctcgacccggtgcccggagcggccgatctcgacaagtgggtcatctatgtgccgcgcgagaactcagaggcggtgcgggcagcggtctttgaggccggtgccggccatatcggcgactactcgcactgcagctggagtgtcgcgggtaccgggcagttcctggcgcacgacggggcgtcgcccgccataggcagcgtcggtaccgtcgaacgggtggccgaggaccgggtcgaggtcgtcgcacccgcacgagcgcgcgccgaggtgttggcggcgatgcgcgccgcgcacccttacgaggagccggcattcgacatcttcgcgctggtaccaccgccggtcggcagcgggttaggccggattggcagactgccaaaacccgaaccgctgcgcacctttgttgcccgtctggaggccgcgttgccgccgactgcgaccggtgtgcgcgccgccggggatcccgacctgctggtgtcgcgggtcgcggtctgcggcggcgccggggactcgttgcttgccaccgtggccgccgcggacgtgcaagcgtacgttacggccgatctgcgacatcatccagccgacgagcattgccgagcttcgcaagtggccctgatcgacgtcgcgcattgggcaagcgaattcccgtggtgcggccaggccgccgaagtgttgcggtctcatttcggcgcgtcgctgccggtgcgtgtgtgcaccatctgcaccgacccgtggaacctcgatcacgaaactgggagagatcaggcatga

SEQ ID NO: 870 - DNA, 1779 bp, Tuberculosis
atggcaacaggggcgagaccggcattaggcttgtcgatcggtgtcaccaacctagcggctgtggctgccgatcactccatcacacgtaaacccgtgctgacgctgtatcgacagcgcccgcccgaggtcggtgtgccatcggagaacccgaggctggacgagccaggcctggtgatcaccgacttcgtagaccgggtgggagattcggtcggcatcgtggctgccgacggctcggtgtaccgcagcgaggcgctagtggctgacgcactgctggcgctggcctacaccgctaccggcggtcgtgctcttcccggaagtgtcacggtgacctatcccgcccactgggggccggctgcggtagcagcgttggatagcgcgctgcgtcgggcctcggaatggtcgcacgggacttcgagtacggcccagccactgtcactgctccctgacgccgcggcagcgctgtacgcgatacgggccgacccgggcataccggcccgtgggatcgtcgcggtatgcgacttcggtggcagcgggaccggcatcacgctcgtcgacgccgcagacgagtatcggccggtggccgcgacggtgcgccatcaggctttctccggcgatctgatcgatcagtcgctgttgagctacgtcatgtccgaactaccgggcacgggcgcgttcgatccagccggcacctcggcgatcggctcactgactaagctgcggatcgaatgtcgcaaagccaaggaacggctttcgtcaagcacggtgaccacgctgaccgacgcgttgggcggggatatccggttgacccgcaacgagctcgaggacacaatccgtgactcgctggacagcgtgggcagggccttggaacaaaccctggcccgcagcggaattcgcacggccgagctggtagcgatcgtttcggtgggtggtggtgcaaatatcccggcagtcaccacgacgctgtccggacgtttctgcgtgccggtggtcaggacgcctcgtccgcaattgacggccgctttcggcggcgcgttgtgggcggcacgcagacccggcgacaccagcgcaacggtgctgaccgcggtcacctcggcgacggcgacggcgccggccgatgcgccggcgtcggtcctgcagcccgctttggcctggtcggaggccgacgaggactcccacatcgggccggcccctggctacacagcggcccgcccgtcgctgagcttcgaccacgatgcccatgcggagcccgagcccaagtccccgccaatcccgtggtatcgcctgccggccgtgatcatcaccggcacgacggtggcggtgttgctggtgggtgccgccgtggcgatcgggttgtccaccggcgaccagccgacggcgccggggaccccgcagaggccgggtgtgaccacgaccgccgcaccgcccccgtccccagcgccggcatccgatggccccactaccgagcccgcacctcccgtacaggcgccagccaccggtgggcccgcgccgccgctgcagcagccgttgccgcctccgccgacaacgacgaatacgcaaccggcggtgaccaccgatgtcatcactccggcaccgacgacccccgcttccgcgccgccggcgaccacgcagccgccggcgaccacgcagccgccggcgaccacgtcccccagccctccaccgatcccgccgatcccaccgattccggagattccgcagctcccccccggaatacctcaggttcccgggatcgggcagttcagcgcgatttcgggtagctga

SEQ ID NO: 871 - DNA, 855 bp, Tuberculosis
gtgcaagcccgtggtcaggtcctgatcaccgccgcggaactggctggcatgatccaggccggcgatccggtgtcgatcctggatgtgcgctggcggcttgatgaacctgacgggcatgcggcctacctacagggtcacctgccgggagcggtatttgtgtcactcgaggacgaactgagcgatcatacgatcgccggccggggccggcacccgctgccgtcgggggctagtctgcaagccaccgtccgccgatgcggaatccgacacgatgtgccggtcgtggtctacgacgactggaatcgagccggttccgcgcgagcgtggtgggtgttaactgcggctgggatcgcgaatgtacgcattctagacggcggcttgcccgcgtggcggtccgcaggcggcagcatcgagaccggccaggtcagcccgcagctcgggaatgtgactgtgctgcacgatgatttgtatgccggacagcggctaaccctaacggcgcagcaagccggtgcgggtggtgtgacgctgctcgatgcgcgcgtaccggaacgtttccgcggcgatgtcgagcccgtggatgcggttgccggtcacatccccggcgccatcaacgttcccagcggtagtgtcctggccgacgacggcacgttccttggcaatggcgcccttaacgcactgctgtccgaccacggcatcgatcacggtggccgcgtgggtgtctactgcggctcgggtgtcagcgcagctgtcatcgtcgcggcactggcagtgatcggccaggatgcggagctgtttccagggtcatggtcggagtggagttcggatccgacccgtcccgtcggccgtggcactgcatag

SEQ ID NO: 872 - DNA, 546 bp, Tuberculosis
atgatcgccgacgaaatccaatcggggctggcctgtacgggttacccgttcgcctgcgaccacgggggtgtgctgccagacatttacctgctcggcaagacacttggtggcggtgcggttccgttgtcggcgatggtcgcggaccgcgaaatcttcggcgtggtgcatcccggcgaacacgggtcgacgttcggcggcaatccgttggccgccgcgatcggtacccccgtggtttccatggtcgtctggggagaatgtcaagctcgctccgctaaattgggtgcgcatctgcatcagcgcctggcggacctgatcggcgatggtgcggtggccctgcgcggcctcggatggtgggctgacgtcgacatcgaacgggcgcttgccattggcacagacatgagcatgcggttggccgatcgcggtgtgctgttaaaagacacctacggcgccgccctgcggttcgcgccgccgttagtgatcaccgcgcaggagatcgactgcgcggttcgccggttcgccgacgcgctatgggaggcgggttcataa

SEQ ID NO: 873 - DNA, 429 bp, Tuberculosis
gtgccatccctaccggaccggctggcatcgatactgcgcgatgtccttcctgccgaggaggaacccgacggcgcgctgacggttcgccatgacggtacgtttgcctcgttgcgggtagtgagcatcgctgaggacctcgagctggtgtcccttacccagatcctggcgtgggatctgccgttgaccaagaggctcgccgagcaagtggccaagcaggcacgcgacatcaacttcggctcggtgagcctgcgggaaaaggtcagcgagaaggctgcgcggcgaagctctggtcggcccgcgtccaacaccgcggacgtgatgctgcgatacaactttcccggcaccggtttgaccgacgacgcgttgcgcacgttgatccttttggtgctggagacgggcgccacgatccgcagcgcgctcgttggctag

SEQ ID NO: 874 - DNA, 318 bp, Tuberculosis
atgatcttcaaaggggtgcgggaaggcaagccgtatcccgagcatggactgtcctatagggactggtctcagataccgccgcaacagatccggctcgacgagttggtcaccacgactacggtgctcgcgctggaccgcctgctgtcagaggactccacgttttacggtgaccttttcccccacgcggtgaagtggcgaggcaccacctatctcgaggacggcttgcaccgggcggtgcgtgcggccctgcgcaaccgcaccgtgctacacgcgcgagtgttcgacatggacgcgtcaccaggcgggcggcgtagctga

SEQ ID NO: 875 - DNA, 507 bp, Tuberculosis
atgaagatggtgaaatcgatcgccgcaggtctgaccgccgcggctgcaatcggcgccgctgcggccggtgtgacttcgatcatggctggcggcccggtcgtataccagatgcagccggtcgtcttcggcgcgccactgccgttggacccggcatccgcccctgacgtcccgaccgccgcccagttgaccagcctgctcaacagcctcgccgatcccaacgtgtcgtttgcgaacaagggcagtctggtcgagggcggcatcgggggcaccgaggcgcgcatcgccgaccacaagctgaagaaggccgccgagcacggggatctgccgctgtcgttcagcgtgacgaacatccagccggcggccgccggttcggccaccgccgacgtttccgtctcgggtccgaagctctcgtcgccggtcacgcagaacgtcacgttcgtgaatcaaggcggctggatgctgtcacgcgcatcggcgatggagttgctgcaggccgcagggaactga

SEQ ID NO: 876 - DNA, 1086 bp, Tuberculosis
atgtcgttcctgattgcttcgccggaggcgctagcggcgacagccacatatttgacaggtatcggttcggcaatcagcgcggcgaacgcggtcgcggccgccccgacaacagagatcctggcggcggggaccgacgaggtgtccaccgccatctcagcgctgttcggcgctcatgcccaggcatatcaggcgctcagcgcccacgtggcggcatttcacgaccagttcgtgcataccttgaccgccggtgccggctcatacatggccgccgaggccgccgccgcctcgcctctgcaggctttgcagctggagctgctcaacgccatcaatgcacccaccctggcgctgttgggacgcccgttgatcggcgacggcaccgatgcggcgccggggagcgggggggccggcggggccggcggcatcttgatcggcaacggcgggaccggcggcgccagcgacttagccgggaccggccgcggcggggtcggcggggcgggcggcgccggcgggctcttcggcatcggcggcgccggcgggggctgcgggtccgcggtggcgatcgggggtgacggcggggctggtggcgccggcggcgtgttcagcggcggcggcgccggcggggccggcgacgccatcgggggtagcggcggcgcgggcggcaccggtgggctgttgggtggtggcggcggcgcgggcggcgccggcggcgccggcggcaatggcgggggcgccagcaacagcgcaagtatcgggggtgacggtgggtccggcggcgcgggcggcatgctctacggtgccggcggcgtcggcggcaacggcggggccgcggtcgctatcgggggtgacggcggggccggcggcagggccggagcgatcggcaacggcggtgacggcggcaacggcgggacttccaacacccccggcggtagcggcggcgacggcggcaatggcgggaacgccggactgatcggcaacggcggtaacggcggcaacgccgagattgtcatctccggcggtagcgtcgccggcaccggtggcaacggcgggttgctgttgggcttcaacggcacgaacgggctgccgtag

SEQ ID NO: 877 - DNA, 672 bp, Tuberculosis
atgagagcgcggcgactggtgatgctgcggcatggacaaacggactacaacgtcggtagccggatgcagggccagctggacactgagttgagcgaacttggccgcacccaagcggtcgcggccgccgaggtgctgggcaagcggcagccgctactgatcgtatcgtcggacctgcgccgcgcatatgacacggcggtcaagctgggcgagcgcaccggccttgtggtccgggtcgacacccgattgcgggaaactcaccttggcgattggcagggcttaacccacgctcagatcgacgctgatgccccgggcgcccggttggcctggcgcgaggatgcgacctgggcgccgcacggcggggaaagcagggttgacgtggctgcccgaagtcggccgttggttgccgagttggttgccagcgaaccggaatggggtggcgctgacgagccggatcgcccggtggtgctggtagcccatgggggtctgatcgccgcgttgtcggcggcgctgctgaagttgccggtggccaactggccggctttgggcggcatgggcaatgccagttggactcagctgagtggccattgggccccgggctccgacttcgagagcatccggtggcgccttgatgtgtggaatgcttcggcgcaggtctccagcgatgtcctctag

SEQ ID NO: 878 - DNA, 636 bp, Tuberculosis
atgggtgggacgttcgaccccatccactacggccacctggttgccgccagcgaggtggccgacctgttcgatctcgacgaagtggtattcgtgcccagcgggcaaccctggcaaaagggtcgacaggtctccgccgccgagcaccgctacctaatgacggtgatcgccaccgcctccaatccccgattctctgtgagccgggtcgacatcgaccgcggcggacccacctacaccaaggacacgctggccgatctgcatgctttgcacccggactctgagctgtacttcaccaccggcgccgatgcgctagcttccataatgtcctggcagggctgggaggagctgttcgaattggcgcggttcgtgggggtcagccggcccggctacgagttgcgcaacgaacacatcactagcctgctgggtcagctggccaaggatgcgttgactctggtcgagatcccggcgctggccatttcgtcgaccgactgccgtcagcgcgccgagcagtcccggccgctgtggtacctgatgcccgacggcgtcgtgcagtatgtctccaagtgccggctctactgtggcgcctgcgacgcgggcgcgcgttcaacgaccagcctggccgctgggaatggcctatga

SEQ ID NO: 879 - DNA, 624 bp, Tuberculosis
atgctcgagaaggccccccagaagtctgtcgccgatttctggttcgatccgctgtgcccgtggtgctggatcacgtcgcgctggatcctcgaggtggcaaaggtccgcgacatcgaggtgaacttccacgtcatgagcctggcaatactcaacgaaaaccgtgacgacctgcccgagcaataccgcgaaggcatggcgagggcatggggaccggtacgggtggcgatcgccgccgagcaggcccatggggcgaaagtcctggacccgctgtacaccgcgatgggcaaccggattcacaaccagggcaaccacgaactcgacgaggtcatcacccagtcgctggcggacgccggtctgcccgcggagttggccaaggccgctaccagcgacgcttacgacaacgccctgcgcaaaagccaccacgccgggatggacgcggtgggcgaggacgtcggtacgccgacgatccatgtcaatggtgtggcgttcttcgggccggtgctctcgaagattccgcgcggcgaggaagccggcaagctctgggatgcctcggttaccttcgcttcctacccgcacttttttgagctcaagcggacccgcaccgagccgcctcagttcgactag

SEQ ID NO: 880 - DNA, 654 bp, Tuberculosis
gtggttgagcgtgggttgtggctccctgacccggctcaccgcgcggatctggccacgttcgtggatcacgcgcttcggctcgacgatgccgccgttatccgtattcgcgcgcggtctaccggattgctatcggcttgggtagcaacgggcttcgacgtgctggccagtcgggtggtggccggcaaggtgcgacccgacgatctgtcggtggccgcacggtcactcgcgcacggtctggccacaacggatgcctcgggctatgtcgatcccggttactcgatggactccgcgtggcggggtgggttgccgccggagtccggcttcacctatctcgacgacgtaccggcccgggtgatgttggacctggcgcaccgtggcgcgcggctggccaaggagcacgggagttcggctggtccgccggtatcgctgctcgatcaggaggtcatccaggtcagctcggccgatgtcgtcgttgggctacccatgcgctgtgtgttcgctttgaccgcaatgggtttccttccccagtccgcagaaacgatcagcgccgacgagctgatccgggtccggatatcgccggcgtggttgcgtctggacgcccgcttcggctcggtttatcggcatcgcggccacgcggcgctggtgctgcgctga

SEQ ID NO: 881 - DNA, 324 bp, Tuberculosis
gtggcgttgcgtagacgccatgagccagacggctggccattttcccagcgctcagaaaaaccgaatgcggtgcgccatgccgtcagatgcagcgccgtgagcgccgccgcgagcacggcgaacggcaccccagtgaactgggtcagtgggcgcgtgacgcgcgcaatgggcgtacaccgccagactcgtggcggcgtcgcgagtgtccatgccgactcgctgcggggtgcggttcttgtccacgggcagctgaggaactcgatccccatcagcgccaacgtccccgccagcggcgctaacacgaagtcgtctatagctcactag

SEQ ID NO: 882 - DNA, 2085 bp, Tuberculosis
gtgtcgttggtgatcgcgacgccgcagctgctggcaactgcggctttggatttagcgagtattggttcgcaggtgagcgcggctaatgcggccgcggcgatgccgacgacggaagtggtggctgcggctgccgatgaagtgtcggcggcgattgcggggttgttcggggcccatgctcggcagtatcaggcgctcagcgtacaggtggcagcgtttcacgagcagtttgtgcaggcgttgactgcggccgcgggtcggtatgccagcactgaggccgctgttgagcggagtctgctgggtgcggtgaatgcgcccaccgaggcgcttttggggcgcccgttgatcggaaacggcgccgacgggacggcacccgggcagcctggcgcggccggcgggttgctgtttggcaacggtggcaacggcgcggctggcgggttcggtcaaaccggcggcagcggaggcgcggccgggttgatcggcaacggcggcaacggcggggccggtggtaccggcgcggccggcggtgccggtgggaacggggggtggttgtggggcaacggcggcaacggcggtgtcggcggcaccagcgtggccgcaggcatcgggggtgcgggcggtaacggcggcaacgccgggctgttcggccatggcggcgccggtggtaccggcggcgccggcctcgccggggcaaacggggtcaatcccacgcccggccccgcggccagcaccggggacagcccggcagatgtgtccggcatcggtgatcaaaccggcggcgacggcggcacgggcggccatggcactgccggcacgccgaccggtggcaccggcggcgacggtgccaccgcgacggcaggctcgggcaaggccaccggcggtgccggtggtgacggcggtaccgccgctgccggtggcggcggcggcaacggcggcgacggcggagtcgcgcagggcgacattgcgagcgcctttggcggtgatggtggcaacgggtccgacggtgtagccgccggcagtgggggtggtagcggcggcgccggaggcggcgctttcgtacacatcgccactgccacctctaccggtggtagcggcggtttcggtggtaacggggctgccagtgccgcctccggcgccgacggtggcgcagggggagctggcggcaatggtggcgccggcgggttgctattcggtgatggcggcaacggtggcgccggtggcgcgggtggtatcggtggtgacggcgccacgggggggcccgggggaagcggcggcaacgctggcatcgcgaggtttgacagcccagaccccgaggcagaacccgatgtggtcggcggcaagggtggtgatggcggcaagggcggcagcggccttggcgtcggcggcgccggcgggaccggcggcgcgggcggcaacggcggcgccggcgggttgttgttcggcaacggcggcaacggcggcaacgccggggccggcggggatggcggcgccggcgttgccggtggggttggcggtaacggcggcggtggtggcaccgcgacgtttcacgaagacccggtcgctggtgtctgggcggtcggtggcgtaggtggtgatggtggctccggcggcagctcgcttggtgtcggcggggtgggcggagccggtggcgtgggtggcaagggtggcgccagcggcatgttgatcggcaacggcggcaacggtggcagcggcggagtcggtggggccggtggagtcggcggggctggcggtgacggcggcaacggcggctccggtggcaacgccagtacttttggcgatgagaactccatcggcggggccggcgggacgggcggcaacgggggcaacggcgcaaacggcggtaacggtggcgctggcggtattgccggcggtgcgggtgggtccggagggttcctcagcggtgccgcaggagtcagcggcgctgacggtatcggtggcgcgggcggcgcaggcggtgccggtggcgcgggcggtagcggcggtgaggcaggcgcggggggcctcaccaacggccccgggtcccctggcgtttccggcaccgaaggcatggccggcgcgcccggctag

SEQ ID NO: 883 - DNA, 222 bp, Tuberculosis
gtgcgaacgacacttgaccttgacgacgatgtgatcgccgcggcacgtgaacttgcctccagccagcgccgctcgctcggctcggtgatttccgaactcgcacgccgtggtctcatgcccggacgcgtcgaggctgacgacgggctgccggtgatccgcgttccagccgggaccccgccgatcacaccggagatggtccgtcgcgcgctcgatgaggactga

SEQ ID NO: 884 - DNA, 657 bp, Tuberculosis
atgagcgccccgggctggagccgagacgagatggccgcacgggtggccgcggagttcgaagacggtcagtatgtcaaccttggcatcggcatgcccaccctgattcccaaccacattcccgacggcgtccatgtcgtcctgcactcggagaacggcatcctcggcgtcggcccctacccgcggcgggaggacgtggatgccgatttgatcaacgcgggcaaggagacggtcaccacgctgccgggtgccgcattcttcagctcgtcgacttcgttcggaatcatccgcggtggccaccttgatgtcgcagtgcttggcgcgatgcaggtttcggtcaccggtgacctagccaactggatgatccccggcaagatggtcaagggcatgggcggcgcgatggatctggtacacggcgctcgcaaggtgatcgtgatgatggagcacaccgccaaggacggtagccccaagatcctagagcggtgcacattgccgttgaccggtgtgggctgcgtcgaccgcattgtcactgaactcgcggtcatcgatgtctgcgctgacggcctgcacctggtccagaccgctcctggcgtgtcggtcgacgaggtagtcgcgaagactcaaccgccccttgtgcttcgggacctggcgacccagtga

SEQ ID NO: 885 - DNA, 747 bp, Tuberculosis
atggacaaggtggtggccaccgccgcggaggcggtcgcagacatagccaacgggtcgtcgcttgcggttggtggattcgggctttgcggcatccccgaagcactgatcgcagcgttggtggatagcggtgtcaccgacctggaaacagtctcgaacaactgcggaatcgacggtgttggtctgggactattgttgcaacacaagcgaattcgccggacagtctcctcctacgtgggggagaacaaggagttcgcccgccagttcctcgcgggcgagctcgaggtggaactgaccccgcagggcacgctggccgagcggttgcgggccggagggatgggcataccggccttctatacaccggcaggggtcggtacccaggtcgccgacggcgggttgccgtggcgctacgacgcctcgggcggggtggcggtggtgtcgccggccaaggagactcgggagttcgatggtgtcacctatgtcctcgagcgggggatccggaccgacttcgcactggtgcatgcctggcagggggaccggcacggcaacctgatgtaccgccacgccgcggccaacttcaacccggagtgcgcatccgcaggcaggatcacgatcgccgaggtcgagcacttggtcgagccgggtgagatcgaccctgccaccgtacacaccccgggcgtgtttgtgcaccgggtggttcatgtgcccaaccccgccaagaagatcgagagggagacggtgcggcaatga

SEQ ID NO: 886 - DNA, 648 bp, Tuberculosis
gtgcaagacgaactggtgtggatcgactgcgagatgaccgggctcgatctgggttcggacaagctgatcgagatagccgccctggtcaccgatgccgatctgaacattctcggcgacggggtggacgtggtgatgcacgccgacgacgccgcgctgtcgggcatgatcgacgtggtcgccgagatgcactcgcggtcggggctgatcgacgaggtgaaggcatccacggtcgacctagcgaccgccgaggccatggtgctcgactacatcaacgagcacgtcaagcagcccaagaccgccccactggccggcaactcgatcgccaccgaccgcgcgttcatcgcccgcgacatgcccacgctggactcgtttctgcactaccgaatgatcgacgtcagctcgatcaaggaactgtgccggcgctggtatccgcggatctacttcggccagccgcccaaggggctgacgcaccgggcgctggccgacatccacgaatccatccgcgaactgcggttctaccgccgcaccgcgttcgtgccccagcccggcccttctaccagcgaaatcgcggccgtcgtcgccgagctttccgacggggcgggcgcgcaggaagaaacagattcggccgaggcgccccagagcggttaa

SEQ ID NO: 887 - DNA, 564 bp, Tuberculosis
gtggcgaccactgctgacttcaagaacgggctggtcctggtaatcgacggccagctgtggacaatcaccgagttccagcacgtcaaaccgggcaagggtccggcgttcgtgcgcaccaagttgaagaacgtgctctcgggcaaggtcgtcgacaagacgttcaacgccggggtgaaggtggacaccgccaccgtcgaccggcgcgataccacctacctttaccgcgacggctcggacttcgtgttcatggacagccaagactacgagcagcacccgctgccggaggccctggtcggggacgcggcacggttcctgctggagggcatgccggtgcaggtggcgttccacaacggcgtgccgctatacatcgagctgccggtgaccgtcgagctcgaggtcactcacaccgagcccggcttgcagggcgaccggtccagcgcgggcaccaagccggccacccttcagaccggagcccagatcaacgtgccgctgttcatcaataccggagacaaactaaaggtggattcgcgcgacggtagctacctgggccgggtcaacgcctga

SEQ ID NO: 888 - DNA, 408 bp, Tuberculosis
atgcgccgccggcggccaccgcacgtcaacgcacccactccgtgcgatcgcggtgatgtgcggccccccggatgccccgctagcatccctggcgtggaagtggctggcggcacccgggcccggctgcgggtcacagccgatggtttgcaggcgctggccgggcggtgcgcgaccctggccggcgaattgtcggccgcggtcgcgccgtcgggggcggtgttgtcgtggcaggccaacgcggtcgcggtgaacgccgcgcatgcccgcgcgggtgcggccgccgcggctgtgagcgcccgaatgcgggccaccgccgccgcgctggggcaggccgcccgccggtacgcgggccaggacaccgcagcggcggccgccctgggggcggtacgcccgtgggggacccactga

SEQ ID NO: 889 - DNA, 1722 bp, Tuberculosis
gtggcatcgtcttcggcgccggtgcaccctgcccgttacctgtcggtgttcctggtgatgctgatcggcatctatttgctggtgtttttcaccggggacaagcacaccgcccccaaactcggcattgacctgcagggcggcaccagggtcacgctgaccgcgcgcacaccggacggctcggccccgagccgggaagcgctggcacaggcgcagcaaatcatcagcgcgcgggtcaacgggctgggagtgtccgggtcggaggtggtcgtcgacggtgacaacctggtcatcacggtgcccggcaacgacggcagcgaggcacgcaacctcggacagaccgctcggctgtacatccggccggtgctcaactcgatgccggcgcagcccgcagccgaagaaccgcagccggcacccagcgccgaaccgcagccgcccggtcaacccgccgcaccgccgccagcccaatcgggggcgccggcttcaccgcaacctggggcccaaccgcggccctatccgcaggacccggcgccatcgcccaacccgacctcaccggccagcccgccgccggcgccgcccgctgaggcgccggccacggatccgcgcaaggatctcgccgagcgcatcgcccaggagaagaagctgcggcagagcaccaaccaatacatgcagatggttgcactgcaattccaggcgacccgctgcgagagcgacgacattttggccggcaacgacgacccgaaactgccgttggtgacctgctcgaccgaccacaagaccgcgtacctgctggcgccgtcgatcatcagcggcgaccagatccaaaacgccacctcgggtatggaccagcgcggcatcggctacgtcgtcgacctgcagttcaagggtccggcggccaacatctgggccgactacaccgccgcccatatcggcacccagacggcgttcaccctggactcgcaggttgtcagtgcaccgcagatccaggaagcgatccccggcggccgaacccagatcagcggtggggatccgccattcaccgcggcgaccgcacgccagctcgccaacgtcctcaagtacgggtcgctgccgctgtccttcgaaccgtcggaagcccaaacggtttcggcgaccttggggttgtcatcgctgcgcgcgggcatgatcgcgggtgcgatcggcctgctgttggtgctggtgtattcgctgctctactaccgagtgctgggactgctcacggccttgtcgctagtggcttctggctcaatggtttttgcgatcctggtgctcttgggccgatatatcaactacaccctagatctggctggtattgcgggcctgatcatcggtatcgggaccaccgccgactcgttcgtggtgttcttcgaacgcatcaaagacgagatccgcgaaggccgttcgttccggtcggcagtgccgcgcggttgggcgcgtgcccgcaagacgatcgtgtcgggcaacgccgtcactttcctggccgctgccgtgctgtactttctggcgatcggtcaggtgaaggggttcgcgttcaccctgggcctcaccacgatcctggacctcgtcgtggtgttcttggtgacgtggccgttggtgtatctggcgtccaaatcgtcgctgctggccaagccggcatacaacggcctgggagcggtgcagcaggtcgcacgcgaacgccgggccatggctcggacgggacggggatag

SEQ ID NO: 890 - DNA, 432 bp, Tuberculosis
atgagccgcaaccgcctgttcctggttgccggcagcttggcggttgccgccgccgtgtccttgatctctggaatcacgctgctgaacagggacgttggctcgtatatcgcctcgcactatcgccaagaatcccgtgacgtgaacggaacgcgatacctgtgcaccggatcgcccaaacaggtggccaccacgctcgtcaagtaccagaccccggcggcgcgcgcgtcgcataccgacaccgagtacctgcgttaccgcaacaacatcgtgacggtcggacccgacggcacctatccgtgcatcatccgcgtcgaaaacctcagcgccggatataaccacggcgcatatgtcttcctgggccctggattcacccctgggtccccgtcgggcggttcggggggcagcccgggcggtcctggcggcagcaagtaa

SEQ ID NO: 891 - DNA, 846 bp, Tuberculosis
gtgtcgatcgaagagatccttgatcttgagcaacttgaggtcaacatctaccgaggaagcgtgttcagccccgaatcgggcttcctgcaacgcactttcggtggtcatgtagccggccagtcgctggtgtcggcggtgcgcaccgtcgacccgcggtacatggtgcactcgctgcacggctattttcttcggcctggagatgccaaggagcgcacggtttttctggtcgaacgcatccgcgacggtggatcgttctgcaccaggcgggtcaacgcagtccagcacggggaaaccatattcagcatggcggcgtcgttccagaccgaacaggagggcattacccaccaagacgttatgccagcggcgccgccgcccgacggcctgccggggttgaactcgatcaaggttttcgatgatgccgggttccggcagttcgacgagtgggacgtgtgcatcgtgccccgggagcgcctgcggcttttgccgggcaaggcttcccagcagcaggtgtggcttcgccaccgtgacccgttgcccgacgacccggtgttgcacatctgtgcactcgcctacatgagcgacctcacgctgctgggatcggcacaagtcaaccacctcgatgtgcgcgaccagctgcaggtggcatcgctggaccatgcgatgtggttcatgcgacccttccgcgccgacgagtggttgctgtacgaccagtcgtcgccgtcggccagcggcggtcgtgcgctgactcggggcgagattttcacacggtccggggagatggtcgcggcggtcatgcaggaggggctgacccgccaccggcgcggtcaccggtcggtggggcagtga

SEQ ID NO: 892 - DNA, 363 bp, Tuberculosis
atgtccacgcaacgaccgaggcactccggtattcgggctgttggcccctacgcatgggccggccgatgtggtcggataggcaggtggggggtgcaccaggaggcgatgatgaatctagcgatatggcacccgcgcaaggtgcaatccgccaccatctatcaggtgaccgatcgctcgcacgacgggcgcacagcacgggtgcctggtgacgagatcactagcaccgtgtccggttggttgtcggagttgggcacccaaagcccgttggccgatgagcttgcgcgtgcggtgcggatcggcgactggcccgctgcgtacgcaatcggtgagcacctgtccgttgagattgccgttgcggtctaa

SEQ ID NO: 893 - DNA, 540 bp, Tuberculosis
atgctgcaccgcgacgatcacatcaatccgccgcggccccgcgggttggatgttccttgcgcccgcctacgagcgacaaatcccctgcgcgccttggcgcgttgcgttcaggcgggcaagccgggcaccagttcagggcatcggtccgtgccgcatacggcggacttgcgaatcgaagcctgggcaccgacccgtgacggctgtatccggcaggcggtgctgggtaccgtcgagagcttcctcgacctggaatccgcgcacgcggtccatacccggctgcgccggctgaccgcggatcgcgacgacgatctactggtcgcggtgctcgaggaggtcatttatttgctggacaccgtcggtgaaacgcctgtcgatctcaggctgcgcgacgttgacgggggtgtcgacgtcacattcgcaacgaccgatgcgagtacgctagttcaggtgggtgccgtgccgaaggcggtgtcactcaacgaacttcggttctcgcagggtcgccacggctggcgatgtgcggtaacgctcgatgtgtga

SEQ ID NO: 894 - DNA, 627 bp, Tuberculosis
ttgccatcgccagcaaccgcccgaccggacaccgccacggtgggagagcgtgtgcgcgctcaagttttatggggcgttttttggcatcatggcattcgcgacccgaaacccggaaagaggagggtggtgttgaaaatgggtaggcgtggtcccgcgccggcgccggcgcagttgaaactcctcggcggccgctcgccgggccgtgattctggcggccggcgggttacaccaccggcggcgttcgagcgtgttgcgccggaatgcccggattggttgccgccaggcgctaaagacatgtgggggcgcgtcgttcccgagcttgcggcattaaacctgctgaaggagtccgaccttggggtgctgacctccttctgcgtcgcctgggatcagctcatgcaggctgtaacagcctaccgtgaacagggtttcatcgcgacgaacgcccgcagccgacgggtgacggtgcatcctgccgtggccgcggcccgggccgcgacgagggacgttttggtgctcgcgcgcgaattggggtgcacgccaagcgctgaggcgaatttggctgctgtgctggcggcggcgggggaccccgacgacgacgagttcaacccgttcgccccagaccggtga

SEQ ID NO: 895 - DNA, 234 bp, Tuberculosis
gtggaggtgagggctagcgcccgcaagcacggcatcaacgacgacgccatgctccacgcataccgcaacgcgctgcgctacgtcgaactggaataccacggcgaagttcaactgctggtgatcggccccgaccaaaccgggcgccttttagagctggtcatcccagcagacgaaccaccccggattatccacgccaacgtactacgcccgaagttctacgactacctgaggtga

SEQ ID NO: 896 - DNA, 804 bp, Tuberculosis
atgacctcttctcatcttatcgacaccgagcagcttctggctgaccaactcgcacaggcgagcccggatctgctgcgcgggctgctctcgacgttcatcgccgccttgatgggggctgaagccgacgccctgtgcggggcgggctaccgcgaacgcagcgatgagcggtccaatcagcgcaacggctaccgccaccgtgatttcgacacccgtgccgcaaccatcgacgtcgcgatccccaagctgcgccagggcagctatttcccggactggctgctgcagcgccgcaagcgagctgaacgcgcactgaccagcgtggtggcgacctgctacctgctgggagtatccactcgccggatggagcgcctggtcgaaacacttggtgtgacaaagctttccaagtcgcaagtgtcgatcatggccaaagagctcgacgaagccgtagaggcgtttcggacccgcccgctcgatgccggcccgtataccttcctcgccgccgacgccctggtgctcaaggtgcgcgaggcaggccgcgtcgtcggggtgcacaccttgatcgccaccggcgtcaacgccgagggctaccgagagatcctgggcatccaggtcacctccgccgaggacggggccggctggctggcgttcttccgcgacctggtcgcccgcggcctgtccggggtcgcgctggtcaccagcgacgcccacgccggcctggtggccgcgatcggcgccaccctgcccgcagcggcctggcagcgctgcagaacccactacgcagccaatcacggtcgacacaatgcataa

SEQ ID NO: 897 - DNA, 411 bp, Tuberculosis
atgacgcgcccaaagctagaactgtccgacgacgagtggcgtcagaagctcaccccgcaggaattccatgtgctacgtcgcgccgggaccgagcggcccttcaccggtgaatacaccgacaccacaacagcgggcatctaccagtgccgggcctgtggcgccgaattgttccgcagcaccgagaaattcgagtcgcattgcggctggccgtcgttcttcgacccgaaaagctccgatgcggtgaccctgcgccctgaccactcgttggggatgacgcgtaccgaggtgctgtgcgcgaactgcgacagccacctgggccacgtgttcgccggcgaggggtatcccacgccaaccgacaagcgctattgcatcaactccatttcgctgcgcctggtccccggtagcgtgtag

SEQ ID NO: 898 - DNA, 633 bp, Tuberculosis
ttgacctccgccggcgacgatgcagagcgcagcgatgaggaggagcggcgcttgacctccgccgagccggccctattccgcgaggcagttgcggcgatgaacgctgtcaccgtgcggccggaaatcgaactcggccctatccgaccgccgcagcggctagctccgtacagctatgcgctgggagccgagatcaagcatcccgaactcgacgtcattccggagcgttccgagggcgacgccttcggccggctgatcatgctgtatgacccggacggctccgatgcatgggacggcactattcgcctggtcgcctatgtccaggccgacctggactcgagtgaagccgtcgaccccctgctgcccgaggtggcatggagttggctggtggacgcgctgacagcgcgcaccgaccaggtgagggccctgggcggcactgtcaccgccaccacatcggtgcgatacggcgacatctccgggccgccgcgcgctcaccagctggagctacgggcgtcatggacggcgaccacccccgatctgggcgcccatgtccaggcgttctgcgacgtcctggagcacgcggccggcctgccgccagccggggtcaccgacctgggctcgcggtcacgcgcctga

SEQ ID NO: 899 - DNA, 486 bp, Tuberculosis
gtgtctgggacgcgcctcgcgccgcacagcgtgcgataccgcgagcgattgtgggtgccctggtggtggtggccattggctttcgcgctagcggcgcttatcgcgtttgaagtaaacctgggcgttgcggccctacccgactgggtaccgttcgcaacgcttttcacagtcgcagccgggacgctgctatggctcggacgtgtcgaaattcgggtcaccgccggctcagcggatggagccggagtgaagctatgggccggaccagcgcatctgccggtagccgtgatcgcccgatcagccgaaatcccggccacggctaaatctgcggcgctgggccgacaactcgatccggcagcttacgtcctgcatcgggcctgggtggggcccatggttctggttgtcctcgacgaccccaacgatcccacgccgtactggttggtgagctgccgccacccggagcgggtgttgtcggcgctgcgcagctga

SEQ ID NO: 900 - DNA, 873 bp, Tuberculosis
gtgacacgacctgacaacgaacccgcgcggctgcgctctgtggccgaaaaccttgctgccgaggcggcggccttcgttcgcggtcgtcgggccgaggttttcggcatctccagggcgggcgacggcgacggcgcggtgcgcgcgaagagcagcccgaccgatccggtgaccgtggtcgacaccgacacggagcggctcttgcgtgatcggttggctcaacttcggcccggtgacccgattctcggggaggaaggtggtggtcccgccgacgtgacggctacaccctccgaccgggtcacttgggtgctcgaccccatcgacggcacggtgaatttcgtctacggcatcccggcgtacgcggtgtcgattggggcacaggttggcggcatcacggtggcgggcgcggtcgccgacgtcgccgctcgcacggtgtattcggcggcgacgggcctcggcgcacatctcaccgatgagcgggggagacatgtgttgcggtgcaccggtgtcgacgagttgtcgatggcgttgctgggtaccggcttcgggtactcggttcggtgccgcgagaagcaggcagaattgctggctcatgttgtgccgttggtccgcgacgtgcgtcggatcggttctgcggcgctggacttgtgcatggtagcggcgggtcggctggacgcctactacgagcacggggtgcaggtgtgggactgtgcggcaggtgcgttgatcgccgctgaggcgggggcccgcgtgttgttgtcaacgccgagagcgggcggcgcggggttggtggtggtggctgccgcgcccggaatcgccgacgagctgttggcggcgctacagcgattcaacggcctagagccgatcccggactga

SEQ ID NO: 901 - DNA, 429 bp, Tuberculosis
atgtcagctagccgcaccatggtctcgtccggatcggagttcgaatcagccgtcggctactcgcgcgcggtacgcatcgggccactcgtggtggtggccggaacgaccggcagcggcgatgatatcgccgctcagacgcgagacgctctgcgccgcatcgagattgcgctcggacaggccggcgcaactctggccgacgtggtccgtacccgcatctatgtgaccgatatttcccgctggcgcgaggtcggcgaagtgcatgcacaggctttcggcaagatccgtccggtgacgagcatggtcgaggttaccgcgctgattgcgcccggcctgctggtagagatcgaggccgacgcctacgtagggtcggcggttgcagaccgaaattcgggagccggcccgaaggacccgtcaccagccggtgggtag

SEQ ID NO: 902 - DNA, 1578 bp, Tuberculosis
atgtcatttgtgatcgcggcaccggagtttttaacggcggcagcaatggacttggcgagcatcggctcgacagtgagcgcggccagtgccgccgcatcagcccccacggtcgcgatcctggccgcgggcgccgatgaggtgtcgatagccgtcgcggcgctgttcggaatgcatggccaggcatatcaggccctcagcgtgcaggcatcggcgtttcatcagcaatttgtgcaggccttgaccgcgggcgcgtactcgtatgcctccgctgaagccgccgccgtgacaccgcttcagcaactagtcgatgtgataaatgcgcccttcagaagcgcgctcggccgccccctgatcggcaacggcgccaacggtaaaccggggaccggacaagacggcggggccggcggactcttgtacggcagcggcggtaacgggggatcagggctggccggctccggccagaagggcggtaacggaggagctgccggattgtttggcaacggcggggccggcggtgccggcgcgtccaaccaagccggcaacggcggcgccggcggaaacggcggcgccggtgggctgatctggggcaccgcggggaccggtggcaacggcgggttcaccacctttcttgatgccgctgggggtgccggcggggccggcggcgccggtgggctgttcggcgcgggcggggccggcggcgtaggcggcgccgccctcggcggcggcgcccaggccgccggtggcaacggcggtgcgggcggggtcggtgggctgttcggcgccggcggtgccggcggcgccggcggcttcagcgacaccggtgggaccggcggggctggcggggccggcgggctgttcggcccgggcggcggctcgggcggcgtcggtggcttcggcgacaccggtgggaccggcggcgacggcggcagcggcgggctgtttggcgtcggcggggccggcgggcacggtggcttcggcagtgctgccggcggcgacggcggcgcgggcggcgccggcggcacggtcttcggctcgggcggggccggcggtgcaggcggagtcgccactgtcgctggccacggtggtcacggcggtaatgccggcctgctatacggcaccggtggggccggcggagccggcgggttcggcgggttcggcggcgacggcggcgacggcggtatcggcgggttggtcggttctggcggcgccggcggcagcggcggcaccggtaccctaagtggtggtcgcggcggggccggcggtaacgccggcacgttctacggttccggcggcgccggcggcgccggcggggagagcgacaacggcgacggcggaaacggcggcgtgggcggcaaggccgggttggtcggcgagggcggcaacggcggcgacggcggtgccacgatagcaggaaagggtggtagcggcggtaacggcggcaacgcctggctgacgggccagggcggcaacggcggcaacgccgcatttggcaaagccgggactggcagcgtcggcgtcggtggcgccggcgggctgctggagggccagaacggcgagaacggattgctgcctagctga

SEQ ID NO: 903 - DNA, 834 bp, Tuberculosis
gtgctcgtcgacgagctcggggtcaagattgtgcacgcgcagcatgtgccggcgccataccttgttcagcgcatgcgagaaatacacgaacgggatgagaatcggcaacgtcatgctcaagtggacgtccagcgacgtcgggatcagccagaacggggccagcaccagcaccgccggaaccgcgacgcggatcatcatccggatggccgcacccttgccggccagatcgttgcgcacccagtctcgcatcgagtccggcagccgcgccccgtagcaatagcggatgtactgccacgggttgggccgcgggcggattgcgttgtcgctcattcgctacagggtagcccgcggcgacgagaacgccgacgcggtcagaccgcgcaccagcgccttggacgccgaagtggtaatgccatagcgtgcccgttgtacctcgaaaatgccgcaggcccagaaccggatacgaagcgggccgaaggtcggcgtttcggtgcgttcggtggcggggatctgcggtggatggccgaccgggtgccgcgccaaggcagcggccggcgcgggttaggtagccgatccggtgcgggtgtgccacaaggcgctgacgcacgcggttggcggcatacggcggacggagttccacgagttggtcagcccgcgattcggcgcggcgtaccgggcttttggtgctggttggaccatgtgctgaccggtttcggtgggcgcaatgccatctgcgcgatcgaggacggggttgagccccgcgtcgcgtggtgggcgttgtgcaccgatttcgacgtgcctcggtcgatgggccgccgcacgcccggtggctga

SEQ ID NO: 904 - DNA, 753 bp, Tuberculosis
gtggccgagaccgcgccgctgcgcgtgcaactgatcgccaagaccgacttcttggccccacccgacgtgccctggaccaccgacgccgacggcggacccgcgctggtcgagttcgccggccgggcctgctatcagagctggtccaagcccaatcccaagaccgccaccaacgccggctacctccggcacatcatcgacgtcggacatttctcggtgctagagcatgccagcgtgtcgttctacatcaccgggatctcgcgatcgtgcacccacgagctgatccgccaccggcatttctcctactcgcagctctcccagcgctacgtacccgagaaggactcgcgggtcgtcgtgccgcccggcatggaggacgacgccgacctgcgccacatcctgaccgaggccgccgacgccgcccgcgccacctacagcgagctgctggccaagctggaagccaagttcgccgaccaacccaacgcgatcctgcgccgcaagcaggcccgccaagccgcccgcgcggtgctgcccaacgccaccgaaacccgcatcgtggtgaccggcaactaccgggcctggcggcacttcatcgcaatgcgggccagcgagcacgccgacgtggaaatccggcgactggccatcgaatgcctgcgccagctcgccgccgtggcccccgcggtgttcgccgacttcgaggtgaccaccctggccgacggcaccgaggtggcgaccagcccgttggcgaccgaagcctga

SEQ ID NO: 905 - DNA, 276 bp, Tuberculosis
atgagtgatggatggaaaaccttgcggttcggggaagtccttgagctgcagcgaggacatgatcttcctgcggcgtcgcggggatctggaacggtacctgttatcgggtcattcggggtgaccggtatgcatgacacagctgcgtacgatggtcccggtgtagccatcggcaggagcggtgcggcgattggtaccgcaactttcgttgcgggtccgatctggccgctggacacttgcctatttgttcgcgacttcaagggcaacgatccccgttag

SEQ ID NO: 906 - DNA, 420 bp, Tuberculosis
atgagcgccgcgactgctgcgtgggaccgccgggcggccgtcgtcgtaggaggcgtcgccgaacccgggtcggccggcccgatcgccggtgccgaccgcaagcggctgatctcgcgaatccaagtgcggcagctggattcggcggcagtggcggccaaacgccggcacttgtattacgtgcggccccttgacggacacccggttgcgcgggtggaccgcaaaaccgaccgcgccgcggacagcttgcccgtggcgggcgtgcttggcgaactcgacataccgccggtcacggttgccgaggggttggccggcgagctggcgtcgatggcgtcgtggctgggattgggggggatcgccgtgtccacccggggtgatctggctggggaactgtgcgcggccaccaagcggactaacggatga

SEQ ID NO: 907 - DNA, 564 bp, Tuberculosis
atgcggtggccgacggcgtggctgctggctctggtgtgtgtgatggcgactgggtgcggacccagtggccacgggacgcgggccggcgaggaggggccgttgagcccggagaaggtcgccgagctggagaacccgttgcgcgccaagcccccgctggaggacgccaaggaccagtaccgggcggcggtgacccagctggccaacgccatcacggccctggtgcccggcctgacgtggcgaacggatatggacacctggaccggctgcggtggtgagtatgaatggaccagggccaaagcggcgtatttcatgatcgttttcagtggaccgatccccgacgacaagtggctgcaggccgtgcagatcgtcaaggacggtgtcgaacagttcggtgccaccggctttggggtgatgaagaacaagccggccgaccacgacgtgtacttcgccggtcatggcggcgtcgagttcaaatgctcgacccagaaggcggcggtcctcaccgcacagtcggactgccggatcagccggaccgacaccccaaaaccctcgccgaccccgtag

SEQ ID NO: 908 - DNA, 327 bp, Tuberculosis
gtgtttcagatcagtccggagcagtggatgcactcggcggcgcaggtgaccacgcagggtgagggtctggccgtcggacatttgtcgtcggactatcggatgcaggccgcccagttcggctggcagggcgcctcggcgatggcgctcaacgccaagatggacgactggttggacgcgtcgagggcgctgctgaccaggatcggtgatcacgcattcgggctgcaggaggccgctatccagcatgcggcggcggaggcggagcgggcgcaggcgctcgcccaggtgggtgtttccgccgacgtcgtagctggtccgcgtggggtgtga

SEQ ID NO: 909 - DNA, 630 bp, Tuberculosis
ttgtacactcccggcaagggaccgccgagggcagggggtgtcgtgttcaccagggtgcggctgatcggagggctcggtgcgctgacggcagcggtggtggtggtgggcacggtgggctggcagggcatccccccagcgccgaccggcggcgacgcggtccagctgcgatcgaccgcggcgcccatgtccaccacgatgaagagcccgatcgtggcgaccaccgaccccagcccgtttgacccgtgccgagacatcccgttcgacgtcatccagcggctcggattggcctacacgccaccggaagccgaggaggggctgcgctgccacttcgacgcgggtaactatcagatggccgtcgagccgatcatctggcgcacctacgcccagaccctgccccccgacgcgatcgagaccacgatcgccggccaccgcgccgcgcagtactgggtgcggaagccgacgtatcacaacagcttctggtactcctcttgcatggtgaccttcaagaccagctacggggtgatccagcagtcgctgttctactcgaccgtctactccgagcccgacgtggactgcccgtcgaccaacctgcagcgggcaaacgacctcgtcccctactacaggttttag

SEQ ID NO: 910 - DNA, 1848 bp, Tuberculosis
atgttgtatgtagttgcgtcacccgacttgatgaccgcggcggctaccaatctggcggagattggttcggcgatcagcacggcaaatggtgcggcggcactcccgactgttgaggtggtggccgcggccgccgacgaggtgtccacgcagatcgcggctctattcggagcgcatgccaggagctaccaaaccctcagcacccaggcagcggcgtttcatagtcggtttgtgcaggcgttgaccacggccgcggcttcctacgccagcgtagaggccgccaacgcgtcgccacttcaggttgcgctagacgtgattaatgcgcccgcccagacactgctcggacgtccgctaattggtaacggcgccgacggatcgacaccggggcaggccggcgggcccggcgggttgctgtacggcaacggcggtaatggcgccgccggtgggcccaaccaggccggcggcgccggcggcaacgccggcttgatcggcaacggcggggcgggcggcgccgggggtgttggcgcggtcggcggtaaacgcggcacgggcggcctgctattcggcaacggcggggccggcgggcaaggcgggctcggcctcgcaggtatcaacggcggcagcggcgggcagggaggccacggtggcaacgccatcctgttcggccagggcggtgccggcgggccaggtggcaccggcgccatgggcgtcgccggcaccaatcccacccccatcggcaccgcagcgcctggcagcgacggcgtaaatcagattgggaacggtggtaacacggacctcaccggcggcgccggtggcgacggcaatgccggcagcaccaccgtgaacggcggcaacggcggtaccggcggcgcagctaggaactcatctggtggtaccggtaactcctttggtggtgccggcggcgccggaggcgacggcgccaacggcggcgacggtggcgctggcggggaagccctcaccgaaggcggtgccaccgccgttagtggtgctggtggtaagggaggtaacgccgaggcttccggcggcgccggcggcaacggcggcaaaggtggctttgctcaggccaccaccagcgtgaccgggggtaacggcggtaacggtggcaatggccacgacagtaacgcgccgggcggcgctggcggcagcggtggcgtcggcggtgacggcggccgtggcggcctgctggccggcaacggcggcaccggcggtgccggtggcaacggcggtaccggtggcgccggtgcccccggcggtgccggcggcgccggcggcaaagccgacatcgccaacagcctcggcgacaatgccaccgtaaccgggggcaatggcgggacaggcggagacggcggcagcgcgctgggcaccgggggggctgggggtgccggaggtctaggtggtcacgggggtgcaggcgggctgctgattggcaacggcggcgccggtggcgctggcggcctcggcggtgcgggcggcgccggcggtgcgggcggtgagggcggtgccggcggcgccggaggcgaagctattcccggcggggcgtccaccaactccgccggcggtgacggaggggcgggcggtactggcggcaatggcggtgacggcggtgccggcggagcccccggcctcggtggcgcgggcggggccggcggatggttgatcggccagtcgggcagcaccggcggcggtggcgccggcggtgccggtggtgccggaggtgccggtggcgcgggcggcagcggcggtgcgggtggccatggcgacactacctccggcaagaacggttcgtctggcaccgcgggcttcgacggcaaccccgggcagcccggctga

SEQ ID NO: 911 - DNA, 864 bp, Tuberculosis
gtgaacgaggcgctgatcggtttggcgttcgccgccgggttggtggctgcgctgaacccatgcgggtttgccatgttgccggcctacctgctgttggtggtgtatgggcaggattcggcgggccggacggggccgcttagcgcagtgggccgagcggcagccgccacggtcgggatggcgctgggcttcttgacggtgttcggcatcttcggagccctgaccatttccgcggccacggcggtgcagcgatacctgccctatgccacggtgctgatcggtctggcgctcatcgccctcggcgggtggctgctgttgggacgagggctgacggcgttgacgccccgatccctcggcgtgcgttgggctccaacggtacggctgggttccatgtatggctacggcatcagctatgcggttgcttcgctgtcatgcaccatcgggccgtttctcgcggttaccggggcaggcctgcggggcggttcggtcgtcgggagcgtagcgatctatctggcttatgtcgcgggcctgaccctcgttgtcggcgtgcttgccgtcgcggccgcgaccgcgagctcggcgctggccgaccgcctacggcgaatcttgccgttcgtcaaccggatcagtggcgcgctgctggtggtggtcgggctgtacgtgggttactacggtctctacgagctgcgcctgattgccggtgtcggggcgaatccccaggatgcggtgattgccgcggccggccgcctgcaaggtgccctggctggctgggttaaccagcacggtgcatggccttgggcggtgttgctggttgtgctggtggtcggtgccttcgccggtacctggtttcggcgggtgcggcgctga

SEQ ID NO: 912 - DNA, 558 bp, Tuberculosis
atgattgatgaggctctcttcgacgccgaagagaaaatggagaaggctgtggcggtggcacgtgacgacctgtcaactatccgtaccggccgcgccaaccctggcatgttctctcggatcaccatcgactactacggtgcggccaccccgatcacgcaactggccagcatcaatgtccccgaggcgcggctagtcgtgataaagccgtatgaagccaatcagttgcgcgctatcgagactgcaattcgcaactccgaccttggagtgaatcccaccaacgacggcgcccttattcgcgtggccgtaccgcagctcaccgaagaacgtcggcgagagctggtcaaacaggcaaagcataagggggaggaggccaaggtttcggtgcgtaatatccgtcgcaaagcgatggaggaactccatcgcatccgtaaggaaggcgaggccggcgaggatgaggtcggtcgcgcagaaaaggatctcgacaagaccacgcaccaatacgtcacccaaattgatgagctggttaaacacaaagaaggcgagctgctggaggtctag

SEQ ID NO: 913 - DNA, 420 bp, Tuberculosis
atgggtctagccgatgacgccccgctgggctatctgctctaccgggtgggagccgtactgcggccagaggtttccgctgcgctcagtccactcggcctgacgctgcctgagttcgtctgcctgagaatgctttcgcagtcaccgggactatccagcgccgaattggcccggcacgcaagcgtcacaccgcaggcgatgaacacggtgttgcgcaagctggaagatgccggtgcggtggcccggcccgcatcggtgtcttccgggcgttcgctaccggctacattgaccgctcgaggccgagccctggcgaagcgcgccgaggccgtcgtacgcgccgccgatgcccgcgtcctggccaggctgaccgcgcctcagcaacgcgagttcaaacgaatgctggagaagctcgggtccgactag

SEQ ID NO: 914 - DNA, 870 bp, Tuberculosis
atgcccgagctgcccgaagtcgaggtggtgcggcgcggcttgcaggctcacgtgaccggccggaccatcaccgaggttcgggtgcaccacccccgcgctgtgcgccgccacgatgccgggcccgcggatctgacggcgcggctgcggggagcgcggatcaacggaaccgatcggcgcggcaagtacctgtggttgacactcaatacggctggggtccataggccgacggacaccgcactcgtggtgcacctgggcatgagtgggcagatgctgctcggggcggtgccgtgtgccgctcacgtccggatttccgcgctgctcgacgacgggaccgtgctgagcttcgctgaccaacggaccttcggagggtggctgcttgccgacctggtgacggtggacggcagcgtggtaccggtgccggtcgcccacctggcgcgcgacccgcttgacccgcggttcgattgtgacgctgtagttaaagtgttgcggcgcaagcattccgaactcaagcgccagctgctggatcagcgggtggtgtcgggaatcggcaacatctatgccgatgaggcgctgtggcgggccaaggtgaacggcgcccacgtcgccgccacactaaggtgccggcgtctgggagcggtcctgcatgccgccgccgacgtgatgcgcgaagcgctggcgaaaggtggcacctcgttcgactctttgtatgtcaacgtcaacggcgagtcgggctacttcgagcggtcgctggacgcttatggccgcgaaggcgaaaactgtcggcgctgcggcgcggtgatacgccgggagaggtttatgaaccgctcgtcgttctactgcccgcgatgccagccgcggccccgaaagtag

SEQ ID NO: 915 - DNA, 786 bp, Tuberculosis
atgctggcccgtcacggaccacgctatggtggctcggtgaacgggcactcagacgacagtagcggcgacgcgaagcaagccgcacccacgctgtatattttcccgcatgccggcggcaccgcgaaagactatgtcgcattttcccgagaattttccgccgacgtaaagcggattgctgtccaataccccggccagcacgatcgttctggcctgccaccgcttgagagtattcccaccctcgctgacgaaatctttgcaatgatgaaaccgtcggctcggatcgacgatccggtggcattctttgggcacagtatgggcggaatgctagccttcgaagtagcgttgcgataccaatcggcgggccatcgagtcctggcattctttgtgtcggcctgctcagcaccgggtcatatcagatacaagcagctccaagatttatcagatcgcgagatgttggacttgttcacccgaatgacaggaatgaatccagatttctttaccgacgacgaatttttcgttggagcgctacccacgttgcgagcggtccgagccatcgccggttattcctgcccaccagagacgaagctctcgtgtccgatttatgcctttatcggagataaagattggatcgcaacgcaagacgacatggatccgtggcgcgatcggacgacggaagagttctctatccgtgtattccctggggatcacttctacctcaacgacaatttgccagagctagtcagcgacatagaagacaaaacactccaatggcatgatcgagcttag

SEQ ID NO: 916 - DNA, 486 bp, Tuberculosis
atgacgggcgcggtatgcccagggtcatttgacccggtgacgttaggccacgtcgacattttcgaacgcgccgcagcccaattcgacgaggtggtggttgccatcctggtcaaccctgcaaagacgggcatgttcgacctcgacgagcggatcgcgatggtcaaggagtcgacaacgcacctgcccaatctgcgcgtgcaggtcgggcatggcttggtggtcgactttgtcaggtcttgcgggatgaccgcgatcgtgaaggggctgcgcaccggcaccgacttcgaatacgagctgcagatggcgcaaatgaacaaacacattgccggtgtggacacctttttcgtcgcgaccgcgccacggtattcgttcgtgtcgtcctcactggccaaagaagtcgcgatgctgggcggtgacgtgtccgagttgctgcccgaaccggtgaatcgccggctgcgggacaggctcaacaccgaacggacctag

SEQ ID NO: 917 - DNA, 567 bp, Tuberculosis
ttgacccggatcatcggcggtgtcgccggaggccggcgcattgccgtcccaccacgcggaaccagacctaccaccgatcgggtgcgcgagtcgctattcaacatcgtgactgcgcggcgggatctgaccggtctggcggtgttggacctctatgcgggttccggcgccctggggctggaggcgttgtcgcggggagcggcgtccgtgctgttcgtggagtccgaccagcgcagcgcggccgtcattgcgcgcaacatcgaggccctaggtctctccggtgcgacgctgcgccggggcgcggtggcggccgtcgtggcggccgggaccacgtccccggtggatctggtgttggccgacccgccctacaacgtcgactccgccgacgttgacgccatcctggccgcactgggcaccaacggctggacgcgcgagggaaccgtagcggtggtggagcgtgcgaccacgtgcgcgccgttgacgtggccggagggctggcgccgatggccccagcgtgtttacggcgacacccgtttggaactggccgaacggctttttgccaacgtgtag

SEQ ID NO: 918 - DNA, 714 bp, Tuberculosis
atgaaccgcagaacgctactgtggctgtcggcgatcgcggcgctggcgctggtggtcgcgtatcagacgctgggatcatcggcgggcaggcacgctgacgagttcgccgcccgcgctggcgtgccaaccgtgcaacccggtgccgacgtgctcgccggcatcgccgtgctacccaaacggatccaccgctacgactaccgcaggtccgcattcggtcacccctgggacgatcgcaatgacgcgccgggagggcacaacgggtgcgacacccgcgacgacatcctcgaccgggatctggtcgacaagacatatgtgtcgatcaagcggtgtccgaatgcggtggccaccggcaccctgcgcgatccgtacaccaacaccaccgttgccttccaacgcggcgccagtgttggccaatcggtccagatcgaccacatcgttccgctctcgtatgcctgggacatgggcgcctatcggtggccgaactccgagcgaatgcgcttcgccaacgatccggccaacctgctggccgtgcaggggcaggcaaatcaggacaagggcgattcgccaccggcccaatggatgccacccaacaaggccttcgcctgtcagtacgcgatgcaattcatcgccgtgctgcgcggctattcactgccagtggatcagccatcgtccgacgtactgcgtcaggccgcggccacctgcccgacgggctag

SEQ ID NO: 919 - DNA, 966 bp, Tuberculosis
atggcgggcgccaaacatgctgggagaatcgtcgcgatcaccaccgcggcggcggtgatactggcggcgtgcagttcgggctccaagggtggagcgggcagcggccacgccggcaaagctcgttcggcggtgaccaccaccgatgccgactggaagccggtggccgacgcgctgggacgtagcggcaagctcggagacaacaacaccgcgtatcggatcaacctgccgcgcaatgaccttcacatcacgtcctacggtgtggacatcaaaccggggctgtcgttgggcgggtacgcggcattcgcccgatacgacaacaacgaaacgctgctgatgggcgacctcgtgatcaccgaggaggagttgcccaaggtcaccgatgcgttgcaggcgcatggtatcgcccagaccgcactgcacaagcatctgctgcagcaagacccgccggtgtggtggacccacattcacggcatgggtgatgccgcccgactggcccaaggactcaaggcggcgttggatgccacaacgatcggcccgcctaccccaccgccggcacggcaaccaccggtcgacatcgacgtcgccggcgtcgaccaggcgttgggccgcaagggaacccaagatggtgggctgatgaagtacagcatcccccgcaaagacaccatcatcgaggacgggcacgtgctgcccgcagtgtcgctgaacctgacgacggtgatcaattttcagccggtgggccgcggtcgcgcagcgatcaacggcgatttcatcctgatcgcccccgaggttcaggaggtcatccgggcaatgcgtgccggcaacatcacgatcgtggaactgcacaaccatgggctgaccgaagagccccgcctgttctacatgcattactgggccgtcgacgacgcggtcaccctggcgcgggcgctgcgcccggcgatggatgccaccaacctgcagtcgtcataa

SEQ ID NO: 920 - DNA, 1002 bp, Tuberculosis
atgttctacgacgacgacgcagacctgtcgatcattcagggccgcaaggttggtgtgatcggctacggcagccaggggcacgcgcactcgctaagcctgcgcgactcgggtgtgcaggtgcgcgtcgggctgaagcagggttcgcggtcgcggcccaaggtagaagagcagggcctggacgtcgacactcccgccgaggtcgccaaatgggccgatgtggtcatggtgttggcccccgacaccgcccaggccgagatcttcgcaggagacatcgaacccaacctcaagcccggtgacgcgctgttcttcggtcacggactcaacgttcacttcggcttgatcaagccgcccgccgacgtcgccgtcgcgatggtcgccccgaagggaccgggtcatttggtgcgccgccagttcgtcgacggcaagggtgtgccgtgtttggttgcggtagagcaggatccgcgaggcgacggcttggcgctggcgctgtcgtatgccaaagcgatcggcggcacccgggccggcgtcatcaagacgacgttcaaagacgagaccgaaaccgacctgttcggtgagcaaacggtgttgtgcggcggcaccgaggaattggtcaaggccgggttcgaggtcatggtcgaagccggctaccccgcggaattggcctacttcgaggtgctgcacgagctgaagctgatcgtcgacttgatgtacgagggtggcctggcgcggatgtactactcggtgtcggacaccgcggaattcggcggctacctctcaggcccgcgcgtcatcgatgccggcaccaaggagcggatgcgcgacatcctgcgggagatccaggacggtagctttgtccacaagctggtcgccgacgtcgagggcggcaacaaacagctcgaagagttgcgccggcaaaacgccgagcaccccatcgaggtcgtcggcaagaaactccgcgacctgatgagctgggtggaccgcccgatcaccgagacggcctag

SEQ ID NO: 921 - DNA, 801 bp, Tuberculosis
atgacgaacatcgtggtcctgatcaagcaggtcccagatacctggtcggagcgcaagctgaccgacggcgatttcacgctggaccgcgaggccgccgacgcggtgctggacgagatcaacgagcgcgccgtggaggaagcgctacagattcgggagaaagaggccgccgacggcatcgaagggtcggtaaccgtgctgacggcgggccccgagcgcgccaccgaggcgatccgcaaggcgctgtcgatgggtgccgacaaggccgtccacctaaaggacgacggcatgcacggctcggacgtcatccaaaccgggtgggctttggcgcgcgcgttgggcaccatcgagggcaccgagctggtgatcgcaggcaacgaatcgaccgacggggtgggcggtgcggtgccggccatcatcgccgagtacctgggcctgccgcagctcacccacctgcgcaaagtgtcgatcgagggcggcaagatcaccggcgagcgtgagaccgatgagggcgtattcaccctcgaggccacgctgcccgcggtgatcagcgtgaacgagaagatcaacgagccgcgcttcccgtccttcaaaggcatcatggccgccaagaagaaggaagttaccgtgctgaccctggccgagatcggtgtcgagagcgacgaggtggggctggccaacgccggatccaccgtgctggcgtcgacgcccaaaccggccaagactgccggggagaaggtcaccgacgagggtgaaggcggcaaccagatcgtgcagtacctggttgcccagaaaatcatctaa

SEQ ID NO: 922 - DNA, 549 bp, Tuberculosis
atggctcactcgatcgttcgcacgctgctggcctcaggtgccgccacggccctgatcgccattcccacagcctgctcgttttcgatcggaacgtcgcactcgcactcggtgagcaaggccgaggtcgcccggcagatcaccgccaagatgacagacgccgccggcaacaagcccgaatcggtgacgtgcccaagcgatctcccggcagaggtcggggccgagctgaattgcgaaatgaagatcaaggaccgcacgttcaacgtcaacgtcaccgtgaccagtgtcgacggtagcgacgtcaagttcgacatggtggagaccgtcgacaagaaccaggttgccaacatcatcagcgacaaactgttccagcgggtgggcgccaggcccgattcggtgacctgccccgacaatctaaagggcgtcgagggagccaaactgcggtgtcgactgaccgacggcagcaaaacgtatggcatctcggtgattgtcaccagcgttgacgccggcgatgtcaacttcgatttcaaggtcgatgaccaccccgagtag

SEQ ID NO: 923 - DNA, 1722 bp, Tuberculosis
ttgacagccgaagcgcccccgctgggagaactcgaagccattcgtccttacccggcccgcaccggtcccaaggggagcctggtctacaagctgatcaccaccaccgatcacaagatgatcggcatcatgtactgcgtcgcgtgcataagctttttcttcatcggtggcctgctggcgttgttgatgcggaccgagctggccgcacccggtctgcagttcttgtcgaatgagcagttcaaccagttgttcaccatgcacggcacgatcatgctgctgttctatgccacgccgattgtgtttggtttcgccaacctggtgctgccgctgcagatcggcgcacccgacgtggccttcccccggctgaacgccttttcgttctggctgttcgtatttggcgccaccatcggggcagccggcttcatcactccgggcggggccgcggacttcgggtggaccgcctacacgccgctgaccgacgccattcactcgcccggcgccgggggcgacctgtggatcatgggtttgatcgttgcgggtctgggcacgatcctgggcgcggtcaacatgatcaccaccgtggtgtgcatgcgcgcacccgggatgacgatgttccggatgccgatcttcacctggaacatcatggtgacgtccatcctgatattgattgcgttcccgctgctcacggcggcattgttcgggctggccgccgaccggcatctgggagctcacatctatgacgccgccaatggcggagtcctgctgtggcagcacctgttttggttcttcggccaccccgaggtctacatcatcgcgctgccgtttttcgggatcgtctcggagatcttcccggtgttttcccgcaagccgatcttcggttacaccacgctggtttatgcgacgctgtcgatcgccgcgttgtcggtcgcggtatgggcgcaccacatgttcgcgaccggagccgtcctgcttcccttcttctctttcatgacgtatctgatcgcggtgccgaccgggatcaagtttttcaactggatcggcaccatgtggaaggggcaattgacctttgaaaccccgatgttgttttcggtgggcttcatggtcaccttcttgctgggcggactcaccggtgtgctgctggccagcccgccgctggacttccacgtcaccgatagctatttcgtggttgcacactttcactacgtgctgttcggcacgatcgtgttcgccaccttcgccggcatctatttctggttccccaagatgaccggccggctgctcgacgagcggttgggcaaactgcacttctggttgacgttcatcggttttcacaccacgttcctggtgcagcactggttgggcgacgagggtatgccgcgtcgctacgccgactacctacccaccgacggcttccagggtctcaacgtcgtctcgacgatcggggccttcatcctgggtgcgtcgatgttcccgttcgtgtggaacgtcttcaagagctggcgctacggcgaggtggtcaccgtcgacgacccgtgggggtacgggaattcgctggagtgggcgacaagttgtccgccgccgcggcacaacttcaccgagctgcctcgcatccgctccgagcgtcccgcgttcgaactgcactacccgcatatggtggaacgccttcgcgccgaggcccacgtcgggcgtcatcatgacgagcccgccatggtgacttcgagctga

SEQ ID NO: 924 - DNA, 864 bp, Tuberculosis
atgttgcagaggggagccggacagtatttcgcgggtaagcggtgctttgtcaccggcgcggccagtggcatcggtcgcgcgaccgcgttgcgcctcgcggcgcaaggtgccgagctgtatctgaccgaccgcgaccgtgatggcttggcgcaaaccgtgtgtgacgcccgtgcactcggcgctcaggtgcccgagcatcgagttctggacgtctccgactaccaggacgtggcggcattcgcggccgatatccacgcccgtcatcccagcatggacgtggtactaaacatcgccggtgtgtcggcctggggcaccgttgaccagctcacgcacgatcagtggagcaggatggtcgcgatcaatctcatgggcccaatccacgtcatcgagaccttggtcccaccgatggtcgccgccggtcggggcgggcacctggtcaatgtgtcctcggcggccgggctggttggcttgccgtggcatgcggcctatagcgctagcaagtacgggttgcggggactttctgaggtgctgcgcttcgatctggcccggcacggcatcggggtgtcggtcgtggtgcctggcgccgtcaagaccccgctggtcaatacggtcgagatcgccggagtggatcgcgacgacccgagggtcaaccgctgggtcgaacggttcagtggtcacgccgtgacgccggagaaggcggccgacaaaattttggccggggtcacaaggaacagatacctggtctatacgtcggcggacatccgggcgctgtatgcgttcaagcgatatgcgtggtggccatacaccctggtgatgcgacgagtcaacgtgttcttcacgcgcgcgcttcggcccgggccatag

SEQ ID NO: 925 - DNA, 411 bp, Tuberculosis
ttgctgacggtcggcgtcgggataggcgcggccatcctcctcgggtggttcacgttagcgcaccggcacccggaccagcctggggcggccgcgacaccaccccctgcggggctaacaacacggtccgcgcccaccgccgccccgccgtcaacgctgcaaagcccagacctggacagcgtctttcttggcaacctgcacgatcgcggcatctcgttcaccaaccccgatgccgccgtctacaacggcaagatggtctgcaccaatctcggcggcggcatgaccgtgcagcaggtggtcgaggcattgcagagtagcagccctgcacttggcgaccggacaaccgcttacgtggccgtctcgattcgcacgtattgtccgaagtacgacgctgtgctgccaccgggatcctga

SEQ ID NO: 926 - DNA, 438 bp, Tuberculosis
gtgaagctcagcaaccagaaacggcactggccgggctatctgttcggccggatccgcacgtcgaccctggtgttgatcgccgcgttcctggcggtgtggtggatttacgagacctataggccacaggcaccaggtcctggtgactctccgccgacccaggtggtgccgccgggcttcgtgcccgatcctgactacacctgggtgccgcgaaccagagtgcaaccacccaccgtcaaggcgacgccgaccaccacgtcgagcacaccgccggtcagcccgcccgaaaccacgaccgattcggctgtcccgccgccgtttgagttgccgccgccgttcggcccgggcaccacgaccccaacaccaccggcaccgctaccgcagcccgggccgggtccgacggccggcacctaccccaaatccgagccaccgacccgttga

SEQ ID NO: 927 - DNA, 513 bp, Tuberculosis
atgatcgaccatgcactcgcgctgacacatatcgatgagcgtggtgcggcacgaatggtcgatgtgtccgagaaacccgtgactttgagggttgccaaagcgtcagggctcgtgatcatgaagccgtctaccttgaggatgatttccgacggtgccgctgctaagggtgacgtcatggcggcggcccggatagctggcatcgcggcggcgaaacgtacgggtgatcttattccgctatgccacccgttagggctcgacgctgtcagcgtcactatcacgccgtgcgagcctgaccgggtgaagattctggcgacaaccaccacgctggggcgtaccggcgtggaaatggaagcgttgaccgcagtttcagtcgccgccttgactatctacgacatgtgcaaagccgtcgatcgagccatggagatttctcagatcgtgctccaagagaaaagcggcggccggtccggagtttatcgccgaagtgcttctgatttggcctgtcagtcccgataa

SEQ ID NO: 928 - DNA, 834 bp, Tuberculosis; identical to SEQ ID NO: 794

SEQ ID NO: 929 - DNA, 1230 bp, Tuberculosis
gtgagtttcgtcgtgctgccgccggagatcaattccttgcgaatgttcatcggtgcaggcactgcgccgatgctggcggcggcggcagcctgggacgggcttgccgaagagttggggaccgcggcgcaatcatttgcgtcggtcacggccgggctggcgggtcaggcgtggcagggtccggcagccttggcgatggcggcagcggcggctccctacgcggggtggttgaccgcggcagcggctcagtcggccggggcggcgggacaggcgcgcgcagtggccagcatcttcgaggcggcgcaggcggcgacggtgcttccggcggcggtggccgccaaccgcgacgcattcgtgcagctggtgatgacgaatttgttcgggcagaacgcgccgttgattgctgccgccgagggtgtgtacgaggagatgtgggccgcggatgtggccgccatgtcggggtactactccggggcatcggcgattgccgcgcaagtggtgccgtgggcgagtttgctgcagcgatttccgggtttgggtgccggcgccaccggcgctactggcggtgagagcgtcggcaccggcgctactggcggcgagagcgtcggcaccggcggcggtgagagcgtcggcaccggaggtgcaaccgctagcggcgggggcgtcggctacgtcggaagcggcgtggctagcgccgggttagcggccggtgatccggcccatggcagtgtaggccaagggaatttcggcggtggcgatgttggcgccggagacgtcgtcgcgtcgagcgctaccagtgcccatgccggcgttgtgagccccggcttcatcggtgccccgctcgcgctcgccgctctgggtcagatggcacgtggcggcactaactctgccccgggaactgccaccgagtcagctcgagcgccagagccggcggcttccgcgccaccggaagccgttgtggaagttccagaacttgaagttccagcaatgggggtgctgccaactgtggatccgaaagttgcggccaaggccgctccgctgtcgacaacgcgggtaggccaatccgcgggttctggaattccggaatcgacactacgcaccgcgcaaggtcagcaggcttcagagacttcagcggcggaggagacagcgccgtcgttgcggccggaagcggcagcgggccaattacgacctcgggtaagaaaggacccgaagattcaaatgcggggcggctga

SEQ ID NO: 930 - DNA, 957 bp, Tuberculosis
atgacgcaccgggcgagcgcgctcatcagcgcacaggagtggttctccgctggggagagggtgggctacgacgctgagcggccgggcatcaacccacgttcgccgctgcgcgcgttcatacggcgcgctgctgggacgggggtcacgcgaacgttcctgcctggctggccggatggttcctacggttgggcgaaggtggaagctttcttgagctcgcgattccacttcccccgcatctacctggactacatcggccacggcgactccgacaaaccccgggattacccgtactcgaccttcgagcgcgcggatctcgtcgaagccctctggcacgccgaggggatagcgcagaccgtcgtcgttgccttcgactactcctgcatcgtcagccttgagctgctggcgcggcggatcgatcgcgagcgggcgggaaacgatcagcggacccgaatcacggcttgcctgctcgccaacggcggcatctttgccgacggccacacccacgcctggtatacgacgccgctgctcacatcgccgctcggcgcggcgatcacgccgatcggccagcgctcatggcgcatgttcgccccattcttgcgccccgtcttctcgcgcggatacccattaagcgcagcggagatgaaggagctccacgacgcgatcagccggcgcgacggcgtgcgcgtgctgcccgccacggcgggcttcgtggacgagcatcgcgagcacgcagcgcgctgggacctggcgcggatcatttcggcgctgggcgatgaggtcgcctttggtgtggtgggcagcgccgaggatccattcgagggagagcaactgcggctcgcccgagagcggcttgcggattcggtggaaatcaccgagcttgcgggcggccacctgacgacagcggagcagcccgatcggctcgccgaggttattgcggccctgcccgagcgttcctaa

SEQ ID NO: 931 - DNA, 360 bp, Tuberculosis
ttgcgactcggcgccggattccgcaaaccggtgccgacactgctactcgaacaccggagccgcaagtccggcaagaacttcgtcgcaccactgctttacatcaccgaccgtaacaatgtcatcgtcgttgcctctgcccttgggcaggcagaaaacccgcagtggtatcgcaacctgccgcccaatcccgacacccacattcagatcggatccgatcgccgcccggtgagagccgtcgtggccagctcggacgagcgggcgcgcctatggccgcgcccagtagacgcctacgccgacttcgattcttgccaaagctggaccgagcgtgggattccggtgatcatcttgcggccacgctaa

SEQ ID NO: 932 - DNA, 306 bp, Tuberculosis
atggcgccggtgaccgacgaacaggtggagctggtgcgctcactggtcgcggccatcccactcggccgggtgtccacctacggcgacatcgcagctctcacagggctttccagtccgcgtattgtcggctggattatgcggaccgattcctcggatctgccctggcaccgggtgatcagagcctccgggcgcccagcacagcacctggccacccggcagttggagttgttgcgcgcagagggcgttctcagtgttgacggccgggtggcgctgagcgagatccgctatgagtttccgccgggctga

SEQ ID NO: 933 - DNA, 333 bp, Tuberculosis
atgcgaggccacgtcgctgaggttaatggcggagttgccgcgatggcgctgtggtttctgaacttttccacctgggacggcgtcgcgggcatctatgtggaggacttgttcgtctggccgaggtttcgccgccgcggcttggcccgtggcctgctgtcgacgctggccagagaatgcgtcgacaaccgctacacgcggttggcctggtcggtgctgaactggaattccgatgcaatcgcactgtatgaccgcatcggcgggcaaccgcagcacgagtggactatctatcgactgtcaggaccgcggttggctgcgctggccgcaccacgctga

SEQ ID NO: 934 - DNA, 552 bp, Tuberculosis
atgagcagcccggtgtcaagccgccgtttggcgaacttggtcaaggagagcctgcagggctcggtgttgggtggggtcgtaagcgatgccgtcttgccagcggtgtcagatgacgtaaagccaggcgcgggcgaggatgcgtaccgcgtgccggtggtcgtggccgcgggctcgggtgcggttgtgcaggtcggcggcctagaggttggctcggcggctgtcgccggcgaagtcgcagacaccgttgcggagttgtttgtctgccgcccaaccgaacccgacgtgggtgactttgtcggactagccggtggagcgggcgacgccggccaagcaggccagcaattcgggctgggcgtcggcgtgcggggcgagtcgttcggcgctcgtcggcgcttggccctgtcgacggtcggcgcgtccggggcaaccgccggactccgcaaaactcatgatggacatcacggctgtcaagcgcgcggggcgctaacccagcggcgcctctacatcggcaatccatccgagatcaccgacacaaggatggtgcaccagtga

SEQ ID NO: 935 - DNA, 645 bp, Tuberculosis
gtggattcaggtcaggttctggccgaaccgaaatcaaacgctgagatcgtgttcaagggccgtaatgtcgagatccccgaccacttccgcatctacgtttcgcagaaactcgcccgcttggagcggttcgaccggaccatctacctgttcgacgtcgaactcgaccacgaacgtaatcgccgccagcgcaagtcctgtcagcgcgtggagatcaccgcgcgtgggcgagggccggtggtgcgaggtgaggcctgcgccgacagcttctatgccgcgcttgaatcagcggtcgtcaaactggagagccggctgcgccgcggtaaggatcgccgcaaggtgcactacggcgacaaaaccccggtttcgctggccgaggcgaccgcggtggtgccagcgccggagaacggcttcaacaccagaccagccgaggcacacgatcacgacggtgccgtcgtcgagcgggagcctgggcggatcgttcgcaccaaagaacacccggccaagccgatgtcggtcgatgacgcgctctaccagatggagctggttggacacgacttcttcttgttctacgacaaggacaccgaacggccgtcggtggtctaccgccggcacgcctacgactacggcttgatccgtctggcgtga

SEQ ID NO: 936 - DNA, 645 bp, Tuberculosis
gtgctaatcgcgattgagggcgttgacggcgctggcaagcggacgttggtggaaaagctgtccggggcctttcgagcagccgggagatcggtggccacactggcgttcccgcgctacggacagtcggtggccgccgacatcgcagcggaggcgctgcacggcgagcacggtgacctcgcatcgtcggtgtatgcgatggcgacgctgttcgcgctcgaccgcgctggcgcggtccacacgatccaggggctgtgtcgcggctacgacgtggtgatcctggatcgctacgtcgcctccaacgcggcctacagcgcggcgcgcctacatgaaaacgcggccgggaaggcagcggcctgggttcagcggatcgaatttgcaagactcgggttgcccaagcccgactggcaggtgctccttgcggtctctgccgagctcgccggggaacgatcccgcggccgtgcccagcgtgaccccggtcgggcgcgcgacaattacgaacgcgacgctgaacttcagcagcgcaccggtgcggtctacgccgagttggcggcccaagggtggggcggccggtggctggttgtcggcgccgatgttgatccgggccgactagcggcgactttggcgcctccagacgtgccaagttga

SEQ ID NO: 937 - DNA, 624 bp, Tuberculosis
gtgcaggtccatgtcgttgaccacccactggccgcggcccgactgaccacgctgcgtgacgaacgcaccgacaacgccggcttccgggcagcgctgcgcgagctcacgctgctgttgatctatgaggccacccgcgatgcgccctgcgagccagtcccgatccgtacgccgctggccgagacggtcgggtcgcggctaaccaagccacccctgctggttcctgtgttgcgggcggggttggggatggtcgacgaggcgcatgccgccttgccggaggcgcacgttggctttgtcggtgtcgcccgcgacgagcaaacccaccagccggtgccgtatctggactcgctgcccgacgacctgacggatgtaccggtcatggtgcttgacccgatggtggccaccggcgggtcgatgacgcacaccctcggtctgctgatctcgcgcggtgcagcggatatcacggtgctgtgtgtggttgcggcgccagaaggaatcgcggcgctgcagaaggctgcgccaaacgtgcggttgttcactgcggccatcgacgaagggcttaacgaggtcgcctacattgtgcccggtctcggcgatgccggcgatcgccagttcggcccgcgctga

SEQ ID NO: 938 - DNA, 846 bp, Tuberculosis
atgttcaccggcatcgctagccatgccggcgccctgggtgccgccttagtggtgctgatcggcgccgcaattctgcacgacggcccagcagcggccgacccaaaccaagacgatcggtttctggcgctgctcgagaaaaaggaaatccccgccgtcgcgaatgtgcctcgcgtcatcgacgcggcccacaaagtgtgtcgcaaactcgatggcggcatgccggtgaacgacattgtggacgggttacgcaacgatgcctacaacatagacccggtcatgcgcctctaccctgtccgcctcacgacgaccatgacccgatttatcagtgcggcagtggagatctactgcccgaaccatcacagcaagatggcgttcgccatggccaatttcgagccgggatcgaatgaaccgacgcatcgcgttgcggcgtccacgcgcagcgcggtcaactcgggaagcgacctgcgggcgtcggtgtcggacatgaccatcatgtcgccgggatggcgggaaccgacgggtgcgatgcttgcctcggtgctcggagcggttcgcgcgggggatcccctgataccgaatccgccgccgattccggtaccgccgccggcggcgcagaccctgattccacccccgccgatcgtggcaccgccgccaccgcgaccagcgccgccgcaacagccgccgcccccgccgccagaggttgagccgcctgctggtgttccgcagtccgggggcgctgccggcagtggcggcgccggcagcggtggtggcggcggtggtgacggaccggtagagccgtcgcctgcacgacccatgccgccgggctttatcaggctcgcgccgtga

SEQ ID NO: 939 - DNA, 1455 bp, Tuberculosis
gcacaggccagtccggcggcccacggcggcagcggtggtgccggtggcaacggcggcgctggctcggccggcaacggcggcgccggtggtgccggtggcaacggcggtgccggcggcaacggtggcggtggcgatgccggcaacgccggctcaggcggcaatggcggcaagggcggcgacggtgtcggccctggctccaccggcggcgcgggcggcaagggcggcgctggcgccaacggcggttccagcaacggcaacgctcgcggtggcaacgccggtaacggcggccacggcggcgccggcggcagcggcgacacgggcggcgccggcggcgcaggtggccagggtgggttcggtggcaccgggggcagcggcagcggcattggcggcggcgccggcggcaacggcggcaacggcggcgccggcggcaccggcgtcgtgcttggcggcaagggcggcgacgggggcaacggtgaccacggtgggcctgccaccaacccgggcagcggcagccgcggcggcgccggcggctccggcggcaacggtggcgccgggggtaacgccaccggctcaggcggcaagggcggcgccggtggcaatggcggtgatgggagcttcggcgctaccagcggccccgcctccatcggggtcacgggcgcccccggcggcaacggcggcaagggcggcgccggtggcagcaaccccaacggctcaggtggcgacggcggcaagggcggcaacggcggtgccggcggcaacgggggctcgatcggcgccaacagcggcatcgtcggcggttccggtggggccggtggcgctggcggcgccggcggaaacggcagccttagctccggcgagggcggcaagggcggcgacggtggccacggcggtgacggcgtcggcggcaacagctccgtcacccaaggcggcagcggcggtggcggcggcgccggcggcgccggcggcagcggctttttcggcggcaagggcggcttcggcggcgacggcggtcagggcggccccaacggcggcggtaccgtcggcaccgtggccggtggcggcggcaacggcggtgtcggcggccggggcggcgacggcgtctttgccggtgccggcggccagggcggcctcggtgggcagggcggcaatggcggcggctccaccggcggcaacggcggccttggcggcgcgggcggtggcggaggcaacgccccggacggcggcttcggtggcaacggcggtaagggtggccagggcggcattggcggcggcactcagagcgcgaccggcctcggcggtgacggcggtgacggcggtgacggcggcaacggcggcaacagcggcgccaaggccggcggcgccggcggcaaagggcaggccggccagcccaactcaggcacggagccagggttcggcggcgacggcggcctcggcggcgccggcgcaacaccctga

SEQ ID NO: 940 - DNA, 492 bp, Tuberculosis
gtgactgccgagaatccaggacggagcaggcggacgctggtcggaatcgacgcggcgatcacggcctgtcaccacatcgcgatccgcgatgatgtcggtgcgaggtcgattcgattcagtgtcgaacccacgctggccggactgcgcaccctcaccgacaagctcagcggttacgacgatatcgacgccaccgtggaaccgacctcgatgacgtggctgccgctcacgatcgctgtcgagaatgccggtgacaccatgcacatggccggcgcgcggcattgcgcccggctgcggggtgcgatcgtgggcaagagcaagtccgacgtcatcgacgccgaggttctcacccgcgccagcgaggtgttcgacctgacgccgctgacactgccgacgcccgcgcagttggcgttacgtcgatcggtgatccgacgtgccggcgcagtgattgacgcgaaccggtcctggcgtcggttgatgtcgttggcgcggtag

SEQ ID NO: 941 - DNA, 372 bp, Tuberculosis
gtgtcggccgcgaccgatctctatgcggtccatcaagcgttggccggtgagagccgggcgattccgaccggcagctgcccgaccgtgggtgtggcgggtttgaccctgggcggcgggttaggcgccgattctcgccatgcggggttgacctgcgatgcgctcaagtcggcgacggtggtgttgcccggcggtgatgcggtgagcgcgtctgccgacgaccacgcggagctgttctgggcgcttcgtggcggcgggggcggcaacttcggggtgacgacatcgatgacgttcgcgaggttccccaccgcggactgcgatgtcgtccgtgtcgatttcgcgccgtctgcggccgcgcaggtgctggtcggctga

SEQ ID NO: 942 - DNA, 552 bp, Tuberculosis
ttgcagcagtgggttgattgcgaattcaccggtcgagacttccgcgacgaggaccttagccgcctgcacaccgaacgggcgatgttcagcgaatgcgatttcagcggcgtgaatctggccgagtcacaacaccgagggtcggcgtttcgtaattgcaccttcgaacggacgacactgtggcacagcacatttgcccagtgcagcatgttgggctcggtcttcgtggcttgccggctgcggccgctgacgttggacgacgtggatttcacgctcgccgtgctcggcggaaatgatctgcgtggtctcaacttgaccggctgccggttgcgagagaccagcctggtggataccgacttgcgcaagtgcgtgctgcgcggcgccgacctcagtggtgcccgtaccacgggcgcccggctggatgacgccgacttgcggggcgcgaccgtggacccggtattgtggcggaccgcgtcgttggtgggtgcgcgtgtcgacgtcgaccaagccgtggcctttgcggcggcgcacgggctgtgcttggcagggggctag

SEQ ID NO: 943 - DNA, 309 bp, Tuberculosis
atgacgccgaccgcttgtgctacagttagcacaatgacctcggtgggggtgcgtgcgctgcggcagcgggccagcgagctgctgcgccgagtcgaggccggcgagacgatcgagatcaccgaccgcggccggcccgtcgccctgctctcgccgctgccgcagggcggtccatacgagcagctgctggcaagcggcgagatcgagcgtgccacgctcgacgtcgttgatctgcccgaaccgctcgacctcgacgcgggcgtcgagctgccgtcggtgacgcttgcgcgcctgcgtgagcacgagcgttga

SEQ ID NO: 944 - DNA, 864 bp, Tuberculosis
atgcccgacgagctgaagccgcacttcgccaacgtgcaggcgcactacgacctgtccgacgacttcttccggctgttcctcgatcccactcagacctacagctgcgcctacttcgagcgcgacgacatgacgctgcaagaggcgcagatcgccaagatcgatctcgcgctgggcaaactcggattgcagccgggcatgacactgttggacgtcggctgcggctggggcgccaccatgatgcgcgcggtggaaaaatacgacgtcaacgtcgtcggtctgaccctgagcaaaaaccaggccaaccacgttcagcagctggtcgccaactccgaaaatctacgctccaaacgcgttctgctggccggctgggaacagtttgacgagcccgtcgaccgcatcgtcagcatcggtgctttcgaacatttcggtcacgagcgctacgacgcgttcttcagcctggcgcatcgcctgctgcccgctgacggggtcatgctgctgcacaccatcaccgggttgcatccgaaagagatccacgaacgcggcctgcccatgtcgttcaccttcgctcgtttcctgaaattcattgtgaccgagatctttccgggtgggcggctgccctcgataccgatggtgcaggagtgtgccagcgcaaacggcttcaccgtcaccagagttcaatcgttgcagccgcactatgcgaaaaccctcgacctctggtccgcggcgttgcaggccaacaagggccaggccatcgcgctgcaatccgaggaagtctacgagcggtatatgaagtacctcaccggctgcgccgagatgtttcgcatcggatacatcgacgtcaaccagttcacctgccagaagtga

SEQ ID NO: 945 - DNA, 627 bp, Tuberculosis
gtgcaatcgcgtaaaaccacctcggtactggcggctgccctgctgttttgcggcctgttaggcccagggacggccccaccggccaccggtggcgggcctgcctgccggccggcagagctcttcgccaccgacaacaccaccgatgggttcgagctaccggccgttgcgactatcgcactaaccggcacggtggtgaccggatcgaccctggtcgacggcgtgttctggtcgaatgagcgccagcagatcggctacgagcgctcccgtgaatttcatctgtgcgttgtcgacgcgcccacattgcacaacgccgccgaggcactgcaccgccagttcaaccaagaagcggtgctgaccttcgactacttgccgcagaatgcacccgaggcggacgcgatcctcatcaccgtgcccgacatcggcatcgcccgcttccgcgatgccttcgcatctgatttggctgcacaccaccgattacggggcggatctgtcaccacagccgaccacaccttaatcctggtcgccggcaacggcgatctcgatgtcgcccgccgactcgtcgaggaggccggcggggactggaacgcaaccaccattgcccatggcaggcgtgaattcgtgaactag

SEQ ID NO: 946 - DNA, 411 bp, Tuberculosis
gtgatctatatggacacctcggccctgactaagctgctcatctccgagcccgagacgaccgaactgcggacatggctgaccgcgcaaagcggccagggcgaggacgcggcgacaagcacccttggccgggtcgagtcgatgagagtcgttgcccgatacggacaaccaggccaaactgagcgtgcgcgttacctactcgacgggctcgacatcctcccgctcaccgaaccggtgatcggtctagctgaaacgatcggaccggccaccctacgttctctcgacgcgattcacctcgcggccgcagcccagatcaagcgggaactgacagccttcgtcacctacgaccaccgattgttgagcggatgccgtgaggtcggcttcgtcaccgcctcacccggcgcagtccggtga

SEQ ID NO: 947 - DNA, 420 bp, Tuberculosis
atgccaccagcaaaaaaagggccggcaacgtcggctaggaagggccagaagacccgccggcgggagaagaagaacgtcccgcacggcgccgcccacatcaagagcacgttcaacaacacgatcgtgaccatcaccgacccgcaaggcaacgtcattgcctgggcatcgtcggggcacgtcggcttcaagggttcccggaaatcgaccccgtttgcggcccagctggccgcggagaacgccgctcgcaaggcccaagaccacggggtgcgcaaggtcgacgtgttcgtcaagggcccgggctcgggccgcgagaccgcgatccggtcgctgcaggccgccggcctggaggtgggcgcgatctcggatgtcaccccccagccgcataacggtgtccggccccccaagcgccggcgcgtctag

SEQ ID NO: 948 - DNA, 858 bp, Tuberculosis
atgaccaattgtgccgccggcaaacccagctcaggccctaacctcggccgattcggatcgttcggacgcggcgtcaccccccagcaggccacagaaatcgaggcgctgggctacggggcggtctgggtgggaggctcaccacccgccgcactgtcctgggtggaaccgattctgcaagcgaccaccacattgtgtgtggccaccggcattgtcaatatctggtcggcaccggcccagcgagtcgccgaatcgttccaccgcatcgaggcggcctacccgggccgctttctgctgggtatcggagtcgggcatgccgagatgatcagtgagtaccgcaagccctacaacgcgctggtggaatacctagaccggctcgacgactatggggtgcccgccaaccgccgggtggtggccgcactgggcccccgggtcctgggcctgtccgcacgccgcagcgccggggcgcacccgtacctgaccacacccgaacacacggcacgggcccgtgagctgattggtccgtcggcgttcctggcgcccgaacacaaggtggtgctgaccaccgactcggcaagggcccgtacggtgggacgccaggcgctcgatatgtacttcaacctggctaactaccgcaacaactggaaacggctgggcttcaccgacgacgaagtctcccggccgggcagcgaccgcctggttgacgccgtggtcgcctacggcactccagacgcgatcgcggcacggctgaacgaacacctgcttgcaggcgccgaccatgtccctattcaggtcctcaccgaagatgacaacctggtgtcggcgctgaccgaactcgcgaagccgctccgactgacttga

SEQ ID NO: 949 - DNA, 507 bp, Tuberculosis
atgcgcccggtggatgagcagtggatcgagatactcaggatccaggcactgtgtgctcggtactgtttgacgatcgacacccaggatggcgaaggctgggcgggatgctttaccgaggacggtgccttcgagttcgacggctgggtgatccgggggcggcccgcattacgcgaatacgcagatgcgcatgcccgcgtcgtgcggggccgccacttgaccacggatcttctctacgaggtcgacggggacgtcgccaccgggcgcagcgccagcgtggtcactctggccactgccgccggctacaagatcctcggctcgggcgagtaccaggatcgcctcatcaagcaggacggccagtggcgtatcgcgtaccggcgattgcgcaacgatcggctggtgtcggatcccagcgtggcggtaaacgtcgccgatgccgacgtcgccgcggtcgtcggtcaccttctcgcggccgcgcgccggctcggaacccagatgagcgacacgtag

SEQ ID NO: 950 - DNA, 4146 bp, Tuberculosis
atgtcgtttgtgttggtttcgccggagaccgtggcggcggtggccacggatctcaagcgcatcggcgcctcgctggcccacgaaaacgcgtcggcggccgcttcgacgacggcggtggtctccgcggccgccgacgaggtatcgacggcggtcgccgctctgttctcccaacacgcccagggctaccaagcggcggccgctcaggtagcagcgtttcatagccggtttgtgcaagccctgacggccggtgccggggcgtacgcatttgccgaggcggccaacgcgtcgccgctacagtcagccatgggtgcggtaagcgcgtctgcgcagacgctgttgtcgcgcccgttgatcggcaatggcgccaatgcgacgacgccgggcggtaacggcggcgacggcggatggctattcggcagcggcggcaacggcgcgcccggcgcggcgggccagtccggcggtaacggcgggtcagccggactgtggggtaacggcggcgcgggtggcgccggcggcagcggcggcgccgccggcggcaacggcggtaacggcgggtggctgttcggcgccggcggcaccggcggtatcggcggcaccggtgctcccggcgccatgggcggcaccggcggcaacggcggcaacggcgcgctgctgatcggcggcggcggcctcggcggcgccggcggcatgggtggcaccggcggcggcaccggcggcaccggcggcaacggcggcaacggcgcgctgctgatcggcgctggtggtgtcggaggtgctggcgggatcggtggccagggtaccggcgccggcggtgccgccggcgccggcggcaccgggggcaacggcggcgccggggggttgttcatgaacggcggcgacggcggcgccggcggtcaaggcggcgacggtgcggccggcgacgcggctgccagcgccggcggcaccggcggcaaaggcggccaaggcggcgacggcggcaccggaggggccggcggcgcaggcccagtgctgttcggccacggcggcgccggcggcatgggcggccaaggcggcaccggtggaatgggcggcgccggcggagacggcaccaccgtcatcgcggccggtaccgggggggagggcggcaccggcggcgcggccggcgccggcggagccgcaggcgctcgcggggctctcaccagcggcggcctagccggcggcgtcggggccggcggcaccggcggcaccggcggtaccggcggcaacggcgctgacgccgctgctgtggtgggcttcggcgcgaacggcgaccctggcttcgctggcggcaaaggcggtaacggcggaataggtggggccgcggtgacaggcggggtcgccggcgacggcggcaccggcggcaaaggtggcaccggcggtgccggcggcgccggcaacgacgccggcagcaccggcaatcccggcggtaagggcggcgacggcgggatcggcggtgccggcggggccggcggcgcggccggcaccggcaacggcggccatgccggcaacacaggtgacggcggcgacggcgggaccggcggtaacggcggcaacggcaccggaggcgtgaacggcgccgacaacaccctcaaccccgacacccccggcggcgccggggagcccggcggggccggcggggccggcggggccggcggggccgccggcggcccgggcggtaccggcggtaccggcggtaacggcggcaacggcggcaacggcggcaacggcggcaacggcggcaacggcggcaacggcggcaatgccggcaacaacagcaccaatgccccagtcggtggcgaaggcggcgccggcggcgacggcggcgccggcggcgcaggcggggccgccaacggcggcaccgcgggcagccagggcactgggggcgtcggcggcgacggcggcgcgggcggcaacggcggcggcggcaaggctggcaccggcaacagcggcaactttggggtggacggcgaagccggcttcagcggcggcgccggtggcaacggcggcgtaggcggggccgccggcgccaatggcggaaccggcggcagcggtggtaatggcggtgacggcggtgcgggaggcattggcggggccggcggcaacggcataccgggcactggcacagagcctgccgggggcaccggcgccaaaggtggagacggcggcgacggtggcgccggcggcgcaggcggcaatgccggcggggccggcggccagggcggcaatgccggccagggtggcgccggcggtgcgggcggcaacgccgtgattcccggcgacggcgtcgggaaggcgccgcacggcgacgcgggcggcagcggcggagacggcggcaaaggcggccagggcggtagtggcggcaccggcggatccggtgccccgatcggtggcggcgccggaggcaccggagggtccggcggacacgccggcaagggtggcgccggcggcatcggcgcacagggcaccaccatcaccgtgcccgggaacggcggcaacgccggcgacggcggcaacggcggcaacgccggcgccggtggaaacggcggctccggcgacttcggtggcaataccaccagcggcgcctccggcagcggcggcaacggcggcaacgccggcaccgcgggtagcggcggtgcgggcggaaccggcggcaccggccttagcggcggcaacggtggcaacggcggcaacggcggcaacggcggtgacggcggtaacggcgcccacggcaccgtcggcgcccagttcgtcccggccaccagcttgcccacacccaacggcggggccggtggcaacggtggcaccggaagcaacggcggcgcgcccggccccgccggggcgcccggccccactaccggcggtaacgctggcagccagggcatcggcggcgacgggggcaacggcggcgacggcggtaaaggcggtgacggcgccgacgctgtcaacgtcgtattcatgccgactgagccacaggccgcgaccggcactgccggcagcgccggtgaccccaccggcggtaacggagggcccggcactcccggcagccccatggttgccccgcccccgccaacgccaatcactcaagtccaacagggcggtgacggtggcgccgggggcaccggatccaccaacgccaacgacggcacagccaccggcggaaagggcggagaaggcggagtcggcagcattctcggcgggcccggcggcaacggcggaactggcggcaacgcctcggcaaccggcaccaacggggtggccaacgccgggaatggcggcaagggtggcgacggcggccagtttggggccggcggcaacggtggtgccggcggcagcgtaaccgacggatccgccggcagcaccgcaggcaacggcggcaacggcggcaacgcaaccaacggcaccatcgcaggccaacccgccggcggcaacggctcggccggcgggaaaggcggcgacggcggcaacatcgccgccggtgccaccggcaccgccggcaacggcgggaacggcggcaacggcaacgacggcgccgtcaacgccggcaccggcggctccggcgggaacggcggtaacgccggtggcggcggcgccaatggcggcgacggcggcgccggcggcgccggcggggccggcgggcgtggcggcaagggcatcgacggcgggttcggcggtgacggcggcaacggcggcagcaacaacggcaccggcgccggtggcaacggcggcaacggcggcaccggcggggtcggctcggttggcgcggctggtggcgatggcggcaacggcggcaccggcggcttcgccggtttcggcggcaccgcaggcaatggcggttccggcggcacgggcggggccggcggcgacggcggcaccggcggggacggcggcaacggcgttatcgccggcggcggggggaccggcggcaacggcggcgccagcggggccggcggcgccggcggcacgggcgggttcgccggcaacggcaatgccggcggcaatggcggcaccggcggcgcgagcgaggacggcgacaacggcaacgctggcagcggcgccaccggcggtaccggcggcaacggcggcaccggcggcgacggcggcgctgccgggctgggcggcgtcgcgtga

SEQ ID NO: 951 - DNA, 861 bp, Tuberculosis
atgcccatcgacttggacgtcgcgctgggtgcacagctaccgcccgtcgaattctcttggaccagtaccgatgtgcagctctaccagctgggactgggcgccggctctgatccgatgaacccccgtgagctgagttatctggcggacgatacaccgcaggtgttgccgacgttcggcaacgtcgcggccaccttccacctcaccacaccaccgaccgtccagtttccgggcatcgatatcgagctcagcaaggtgctgcacgccagcgagcgagtcgaggttcccgccccgctgccgccgtcgggttcggccagggcggtcacccggttcaccgacatctgggacaagggcaaagccgcggtaatctgcagcgaaacgacggcgaccacaccggacggcttgctgctgtggacgcagaagcggtcgatctatgcccgtggcgaaggcggattcggcggcaagcgcgggccgtcgggatcagatgtcgcgccggagcgggcgcccgatctgcaggtcgcgatgccgattctgccgcagcaagcgctgctctaccggctctgcggcgaccgcaacccgctgcactcggatcccgaattcgccgctgccgcaggctttccccggcctattctgcatggcctgtgcacctatgggatgacctgcaaggcgatcgtcgatgcattgctggactccgatgcgacggccgtggccggctacggcgcacgctttgctggcgtggcgtacccgggcgagacgctcacggtcaacgtgtggaaggacggccgccgcctggtggccagtgtcgtcgcacccactcgtgacaacgctgtggtgctcagcggagtggagctggtgccggcatag

SEQ ID NO: 952 - DNA, 870 bp, Tuberculosis
atggacgaacttccatggcccgtcctgggctcggaagtgttggccgcaaaggccattccggagcgggccatgagacagctctacgagccagtctacccgggcgtctacgccccggccggtgtggagctgacggcgcgccagcgcgcccacgcggcgtggctgtggtcgcggcgccgcgccgtcgtggccggcaattcggcggcggcgctgcttggcgcgaagtgggtaaacccagcgcttgacgcagagttagtgcacgccaatcgaaagcctccgccgcgcatcgtcgtgcacacggatcgattggcgccgcacgagacggttgcggttgacggtgtcgcggtaaccaccccggcgcgcaccgccttcgatatcgggcggcgcacaccctcgcggctgcaggccgttcaacggctggacgcgttggcgaattcgaccgatgtcaaggtcgccgacgtgcaggccgtcattgccgaacataccggtgcgcgcggcctggtccgcctccgtgcggtgctgccgctgatcgacgggggtgcggaatccccacaggagacgtggacccgattggtgttgatcgatgccggtctgccgaagccgcaaacacagatcagagtgtttgacgactacggggacttcgtcgcccgcatcgacctgggctacgagcaattgcgagtcggtgtcgagtatgacgggccacagcattggacagacccggcgcagcgggctcgggacatcgagcggtccaccgcgttgctggatctgggctggacgatcatcagggtcaccagtgagctgctctggtaccgccggggcacgttcgttggccgcgtcgatgccgcgatgcgggcggcgggatggcgcccatga

SEQ ID NO: 953 - DNA, 564 bp, Tuberculosis
atgtcggctcagatcgatccacgcacgttccgctccgtgctcggtcagttctgtacggggatcactgtcatcaccactgtgcacgacgacgtgcccgtcgggtttgcgtgccagtcgttcgcggcgctgtcgttggaaccgccgttggtgctgttctgccccactaaggtgtcgcggtcctggcaggccatcgaggccagcggccggttctgcgtcaacgtactgaccgaaaagcagaaagacgtctcggcgcgattcggctcgaaggagccggacaagttcgccggtatcgattggcgcccttcggaactaggctcaccgatcatcgagggatcgctggcctacattgactgcacggtggcgtcggtgcacgacggcggcgatcacttcgtggtgttcggtgccgtcgagtcactgtcagaggtcccggcggtcaagccgcggccgctgctgttctatcgcggcgactacaccggcatcgagccggaaaagaccacgccggcgcactggcgcgacgacctggaggctttcctcatcaccaccacccaggacacctggctctag

SEQ ID NO: 954 - DNA, 1755 bp, Tuberculosis
atgtcgtttgtgatcgtggcgccggaagcgctgatgtcggtggcttcagaggtggccggtatcggttcggcgctcaatgccgccaacgccgccgcggccgccccgaccacgggtgtgctagcggccgccgcggacgaggtgtcggcggcgatggcggcgctgttcggcgcgcacgcccaggagtaccagaggctcagcgcccaggcggcggggtttcatgcccagttcgtgcaggcgttaaacgcgggagtgaactcctatgccagcgccgaggccgccaacgcgtcgccgctgcaagccgtggagcagcaggtgctcggcttgatcaacgggcccgcgcagacgctactggggcgcccgttgatcggcaacggtgccgacggggcgccgggaaccgggcagccgggcgggcccggcgggctgctgtggggtaatggcggcaacggcgggtcgggtgtggccggtgtgggcgggcccggtggtagcggcggcgccgccgggctgttcgggcacggcggcaatggcggggccggcgggagcaacgccgccggcgccggcggtgtgggcggagccggtggggcgggctggctggtcggcaacggcggtgccggcgggttcggcggggtgggaacgaccgtcagtggcaacggaggagccggcggcgccgccggcgcgttcggcaatggcggtgtgggcggggcgggcggggccgcggtcatcggcgggttgcccggcaatgggggtgccggcggcaacgcggggctgatcggcgccggcggcgacggcggcgtcggcggggtgggtgcccccggaaccaacgggatgaacccgccgccgaaccagaccagccaggcggcaaacggaagccccggcgccaacaacggcgccggtagcggtggcgcagggctgcccggcaacccgggtgccgtaccagggcgggctggcggcgctggcggtttaggcggcagcggcagcgatacgagtgaaggccctgtgacggggggcaacggaggcaatggcggcgacggcggtcccggcgcgcccggcggcaacggcgcacccggcggcatcggtgtcaataccggtactggctgggcctacgggggaaacgggggcaatggcggtgacggtggcgccggcgcccggggcggcgacgggggcaacgggggcaacggcctagcgctaaacggtggcaacgggatcggcggcaacggtggcgccgggggccggggcggcaccggggctgcgggcggcaatggtggcattggcggcggcgccaccggcacgctgaccttttttggtagcggaggcgacggcggccccggcggggctggcgccaacaccgccggcaccgggggtgtcggcggtgtcgggggtgcgggcggtcagggcgggctgctgttcggcgacggcggtaacgggggcgccggcggtgccggcggcatcggcggcacgggtgcctcgggcggcgccggaggcaagggcggctctggcctggtcggcggtgacggcggcaacggtggtgccggcggcgccggcggcaacggcggcaagggcggtgccggaggtgccggcggaggtgccggaatgttcagccagccaggtgtccacggtgcgggcggtaccgggggccagggaggtgccggcggcgctggcggcgcgggtggcgccgcgggagctgggacagtcgtcgcgggcaaccccggtgatcccggcggtttcggcgccgccggtgcggacggcctacccggctaa

SEQ ID NO: 955 - DNA, 651 bp, Tuberculosis
ttgacgcccgcgttggtcgttggtcccgcggcgtggcacgctgtgcacgtgacccagagctcctcggcgatcacccccgggcagacggcggagctttatccgggggacatcaagtcggtgctgctcacggccgagcagattcaggcccgcatcgccgagctcggcgagcagatcggcaacgactaccgcgagctgtccgctaccaccggccaggatctgctgctgatcaccgtgctgaagggcgcggtgctcttcgtcaccgacctggcgcgagcgattcccgtgccgacccagttcgagttcatggcggtgagttcgtatgggtcatcgacatcctcgtcgggcgtggtgcggatcctcaaggacctcgaccgcgacatccacggccgcgacgtgctgatcgtcgaggacgtcgtcgactccggccttacgctttcgtggttgtcgcggaacctgacgagccggaatccgcggtcattgcgggtgtgcacgctgctgcgcaagcccgatgcggtgcacgccaacgtcgaaatcgcgtacgtgggtttcgacattcccaacgacttcgtcgtgggctacggcctggactacgacgaacgctaccgtgacctgtcatacatcgggacgctggaccccagggtctatcagtag

SEQ ID NO: 956 - DNA, 726 bp, Tuberculosis
atggcctcgaaaatggacactgaaacgcactactcggacgtctgggtcgtcattcccgccttcaacgaagccgccgtgatcggcaaggtcgtcaccgatgtgcggtcagtcttcgaccacgtcgtctgcgtggacgacggcagcaccgacggcaccggcgacatcgcccggcggtccggtgctcacctcgtacgccatccgatcaacctgggccagggggcggccattcagaccggaatcgagtacgcccgcaagcagccgggcgcccaggtctttgccacctttgacggcgacggccagcaccgcgtcaaagacgtggccgcaatggtcgaccggctcggcgcaggtgacgtcgatgtggtgatcggaacgcggttcggccggcccgtgggcaaagcttcggccagccgaccgccactgatgaagcggatcgtgctgcagacaggagcgcggttgagccgtcgaggccgccgacttggcttgaccgacaccaacaatggcctgagggtgttcaacaagaccgtggccgacgggctgaacatcaccatgagcggcatgagccacgccaccgagttcatcatgttgatcgccgaaaaccattggcgggtagcggaagaaccggtcgaggtgctctacaccgagtattcgaagtcgaaaggccaaccgctgctcaacggcgtcaacatcattttcgacgggtttctgcgagggaggatgccacgatga

SEQ ID NO: 957 - DNA, 567 bp, Tuberculosis
atggcgggtctcttcacgcccccggcttccggtgccgcgacacttcagcgtgctgcgcgagatgctgccccggacgcgcgctggctactcgcggtctccgaccgcaacgggatcgtcagcacttcggcgacgacgtgcaactacccgcccgctgcgaaagactctgcgcaagacgggtttaggcacgcactggccgctgccatcgctgcggacatcgatgaagcactccgtcacggctacggagatctgcttgagcttgcgtacccgctcatgagctggccgcgccggggcgtttttggcgggccgaccccggccccacgtgggctcgctacgcgacagtgcccgccccggacagttcacgttgaccgggtgaggccaaacggcgccgagcgtgcactgagggcgagattccggccgattctccgccctcagttcacgctgggcgacggcgctaacgggctgcccttggccgcgtgcaccaagacgggtgcatacgtgccgcacttgccatactcacccatcgcggtggacccccaacccagtgccggtcaacaagggccttcctga

SEQ ID NO: 958 - DNA, 207 bp, Tuberculosis
atgttggtgatcaccatgtttcgtgtactcgtggcgcggatgacggcgctggcggtcgacgagtcgggcatgtccaccgtggaatacgccatcggtaccatcgcggcggctgccttcggtgcgatcctctacacggtcgtcaccggggattccattgtgtcggcgctcaaccgcatcatcggtcgcgcgctcagcaccaaggtttag

SEQ ID NO: 959 - DNA, 675 bp, Tuberculosis
gtggacgagatcctggccagggcaggaatcttccaaggcgtggagcccagcgcaatcgccgcactgacgaaacagctgcagcccgtcgacttcccccgtggacacacggtcttcgcggaaggggagccgggcgatcggctgtacatcatcatctcggggaaggtcaagatcggtcgccgggcaccagacggccgagaaaacctgttaaccatcatgggcccgtcggacatgttcggcgagttgtcgatcttcgacccgggtccgcgcacgtccagcgcgaccacgatcaccgaggtgcgggcggtgtcgatggaccgcgacgcgctgcggtcatggatcgccgatcgtcccgaaatctccgaacagctgctgcgggtgctggcccgccggctgcgccgcaccaacaacaacctggccgacctcatcttcaccgatgtgcccggtcgggtggccaagcagctgttgcagctcgcccagcgtttcggcacccaggaaggtggcgcattgcgggtcacccacgacctgacacaggaagaaatcgcccagctggtcggggcctcacgcgagacggtgaacaaggcactggctgatttcgctcaccgcggctggatccgccttgagggcaagagtgtgctgatctctgactccgaaagactggcccgccgagcgaggtaa

SEQ ID NO: 960 - DNA, 369 bp, Tuberculosis
ttgtcagctcccgactcgatcaccgtcacggttgccgaccataacggggtcgccgtgctcagcatcggtggtgagattgatttgatcaccgctgcggcacttgaagaggccatcggcgaagttgtggccgacaatccgacggcgctagtcatcgacctttccgcggtggagtttctggggtcggtggggctgaagattttggcggcaacatccgaaaagataggccaatccgtcaagttcggggtggttgcacggggttcggtaaccagaaggccgattcatctgatgggtctggacaagacctttcggttgttttccacgctccacgatgccttgactggggtacggggcggcaggatcgaccggtaa

SEQ ID NO: 961 - DNA, 966 bp, Tuberculosis
gtggtgcgtatcgcttacctcggtccggaagggacattcaccgaggcagccctggtccggatggtggccgccggcctagttcccgagaccgggcccgatgcactgcagcggatgccggtcgagagcgcgcccgcagcactggctgcggtccgcgacggcggtgcggattatgcgtgcgtgccgatcgagaactcgatcgacggttccgtgctgcctactttggatagcctggccatcggtgtgcgcctgcaggtgttcgccgagacaacgctggacgtgacgttcagcatcgtggtcaaacccgggcgcaacgccgcggacgtgcggaccctggcggcctttccggtggcggctgcacaggtgcggcagtggttggcggcccatcttcccgccgccgacctgcggccggcttattccaacgcggacgcggcccggcaggtggctgacggcttggttgacgccgcggtgacctcgccgctggcggccgctcgttggggattggcggccctggccgacggtgtcgttgacgaatccaatgcccgcacccgcttcgtcctggttggtcggcccgggccgcctccggcgcgcaccggagccgatcgcacgtctgcagtgctgcgcatcgacaaccagcccggtgcgctggtagctgcgctggccgagttcggcatccgcggcatcgatctcactcggattgaatcccggcccacccgtaccgaacttggcacctatctgttcttcgtggattgcgtcggccacatcgacgacgaggccgtcgccgaggcactcaaggcggtgcaccgacgttgtgctgatgtgcgatacctggggtcctggccgacggggccagcggcaggggcgcagccgcccctggtagacgaagcatcacgctggttagcgcggctccgcgcgggcaaacccgagcagaccctggttcgcccggacgaccagggggcgcaagcatga

SEQ ID NO: 962 - DNA, 2190 bp, Tuberculosis
atgagtattaccaggccgacgggcagctatgccagacagatgctggatccgggcggctgggtggaagccgatgaagacactttctatgaccgggcccaggaatatagccaggttttgcaaagggtcaccgatgtattggacacctgccgccagcagaaaggccacgtcttcgaaggcggcctatggtccggcggcgccgccaatgctgccaacggcgccctgggtgcaaacatcaatcaattgatgacgctgcaggattatctcgccacggtgattacctggcacaggcatattgccgggttgattgagcaagctaaatccgatatcggcaataatgtggatggcgctcaacgggagatcgatatcctggagaatgaccctagcctggatgctgatgagcgccataccgccatcaattcattggtcacggcgacgcatggggccaatgtcagtctggtcgccgagaccgctgagcgggtgctggaatccaagaattggaaacctccgaagaacgcactcgaggatttgcttcagcagaagtcgccgccacccccagacgtgcctaccctggtcgtgccatccccgggcacaccgggcacaccgggaaccccgatcaccccgggaaccccgatcaccccgggaaccccaatcacacccatcccgggagcgccggtaactccgatcacaccaacgcccggcactcccgtcacgccggtgaccccgggcaagccggtcaccccggtgaccccggtcaaaccgggcacaccaggcgagccaaccccgatcacgccggtcacccccccggtcgccccggccacaccggcaaccccggccacgcccgttaccccagctcccgctccacacccgcagccggctccggcaccggcgccatcgcctgggccccagccggttacaccggccactcccggtccgtctggtccagcaacaccgggcaccccagggggcgagccggcgccgcacgtcaaacccgcggcgttggcggagcaacctggtgtgccgggccagcatgcgggcggggggacgcagtcggggcctgcccatgcggacgaatccgccgcgtcggtgacgccggctgcggcgtccggtgtcccgggcgcacgggcggcggccgccgcgccgagcggtaccgccgtgggagcgggcgcgcgttcgagcgtgggtacggccgcggcctcgggcgcggggtcgcatgctgccactgggcgggcgccggtggctacctcggacaaggcggcggcaccgagcacgcgggcggcctcggcgcggacggcacctcctgcccgcccgccgtcgaccgatcacatcgacaaacccgatcgcagcgagtctgcagatgacggtacgccggtgtcgatgatcccggtgtcggcggctcgggcggcacgcgacgccgccactgcagctgccagcgcccgccagcgtggccgcggtgatgcgctgcggttggcgcgacgcatcgcggcggcgctcaacgcgtccgacaacaacgcgggcgactacgggttcttctggatcaccgcggtgaccaccgacggttccatcgtcgtggccaacagctatgggctggcctacatacccgacgggatggaattgccgaataaggtgtacttggccagcgcggatcacgcaatcccggttgacgaaattgcacgctgtgccacctacccggttttggccgtgcaagcctgggcggctttccacgacatgacgctgcgggcggtgatcggtaccgcggagcagttggccagttcggatcccggtgtggccaagattgtgctggagccagatgacattccggagagcggcaaaatgacgggccggtcgcggctggaggtcgtcgacccctcggcggcggctcagctggccgacactaccgatcagcgtttgctcgacttgttgccgccggcgccggtggatgtcaatccaccgggcgatgagcggcacatgctgtggttcgagctgatgaagcccatgaccagcaccgctaccggccgcgaggccgctcatctgcgggcgttccgggcctacgctgcccactcacaggagattgccctgcaccaagcgcacactgcgactgacgcggccgtccagcgtgtggccgtcgcggactggctgtactggcaatacgtcaccgggttgctcgaccgggccctggccgccgcatgctga

SEQ ID NO: 963 - DNA, 1383 bp, Tuberculosis
atgacgcagtcgcagaccgtgacggtggatcagcaagagattttgaacagggccaacgaggtggaggccccgatggcggacccaccgactgatgtccccatcacaccgtgcgaactcacggcggctaaaaacgccgcccaacagctggtattgtccgccgacaacatgcgggaatacctggcggccggtgccaaagagcggcagcgtctggcgacctcgctgcgcaacgcggccaaggcgtatggcgaggttgatgaggaggctgcgaccgcgctggacaacgacggcgaaggaactgtgcaggcagaatcggccggggccgtcggaggggacagttcggccgaactaaccgatacgccgagggtggccacggccggtgaacccaacttcatggatctcaaagaagcggcaaggaagctcgaaacgggcgaccaaggcgcatcgctcgcgcactttgcggatgggtggaacactttcaacctgacgctgcaaggcgacgtcaagcggttccgggggtttgacaactgggaaggcgatgcggctaccgcttgcgaggcttcgctcgatcaacaacggcaatggatactccacatggccaaattgagcgctgcgatggccaagcaggctcaatatgtcgcgcagctgcacgtgtgggctaggcgggaacatccgacttatgaagacatagtcgggctcgaacggctttacgcggaaaacccttcggcccgcgaccaaattctcccggtgtacgcggagtatcagcagaggtcggagaaggtgctgaccgaatacaacaacaaggcagccctggaaccggtaaacccgccgaagcctccccccgccatcaagatcgacccgcccccgcctccgcaagagcagggattgatccctggcttcctgatgccgccgtctgacggctccggtgtgactcccggtaccgggatgccagccgcaccgatggttccgcctaccggatcgccgggtggtggcctcccggctgacacggcggcgcagctgacgtcggctgggcgggaagccgcagcgctgtcgggcgacgtggcggtcaaagcggcatcgctcggtggcggtggaggcggcggggtgccgtcggcgccgttgggatccgcgatcgggggcgccgaatcggtgcggcccgctggcgctggtgacattgccggcttaggccagggaagggccggcggcggcgccgcgctgggcggcggtggcatgggaatgccgatgggtgccgcgcatcagggacaagggggcgccaagtccaagggttctcagcaggaagacgaggcgctctacaccgaggatcgggcatggaccgaggccgtcattggtaaccgtcggcgccaggacagtaaggagtcgaagtga

SEQ ID NO: 964 - DNA, 747 bp, Tuberculosis
gtgtccgacggcgaacaagccaaatcacgtcgacgccgggggcggcgccgcgggcggcgcgctgcggctacagccgagaatcacatggacgcccaaccggccggcgacgccaccccgaccccggcaacggcgaagcggtcccggtcccgctcacctcgtcgcgggtcgactcggatgcgcaccgtgcacgaaacatcggctggagggttggtcattgacggtatcgacggtccacgagacgcgcaggtcgcggctctgatcggccgcgtcgaccggcgcggccggctgctgtggtcgctacccaaggggcacatcgagttgggcgagaccgccgagcagaccgccatccgcgaggtcgccgaggagaccggcatccgcggcagtgtgctcgccgcgctggggcgcatcgactactggttcgtcaccgacggccggcgggtgcacaagaccgtccaccattatttgatgcggtttttaggcggagagctgtccgacgaagacctcgaggtagccgaggtagcctgggtgccgatccgggaactgccgtctcgactggcctacgccgacgaacgtcgactagccgaggtggccgacgaactgatcgacaagctgcagagcgacggccccgccgcgcttccgccgctaccacccagctcgcctcgtcgacggccgcaaacgcattcacgcgctcgtcatgccgatgactcagcaccgggtcagcacaacggtcccgggccggggccgtga

SEQ ID NO: 965 - DNA, 735 bp, Tuberculosis
gtgtccgctcgtatcacagcgttacgactcgaagccttcgagcagctccccaagcatgcgcgacgctgcgttttctgggaggtcgaccccgcgattctcggcaaagacgaccacctcgccgaccccgaattcgaaaaggaagcctggttgtcgatggtgatgctggagtggggttcgtgcggtcaggtcgcaacggcagtcccggatgagcgcagccacgccgaaccaccctgcctcgggtatgtgctctacgctccgcccagtgcggtgccgcgagcccagcggtttcctaccgcgccggtgtcggcggacgcggtgctgcttacgtcgatgggcatcgagcgcgggcaagcagatgacgacttaccgcacagtctgattgcccgggtgattgaagagttggttcggcgcggcgtccgggcgctggaagctttcggccggacaccagcggccaccgatttgcaaaacccgggcgcggtaacacctgatgtgcggccggtgttggaggccctcggcgactgctgtgtcgaacactgcatcatcgacgcgaacttcttgatggacgtgggtttcgtcgtggtggcaccgcacccgtactttccgaggctacgcctcgaactggacaaagggctggggtggaaagccgaagtcgaggccgctcttgaacgcttgctggagaatgctcgactgcaagagccgatagcagcggggtcgacggccggcaacacgtcgtaa

SEQ ID NO: 966 - DNA, 2004 bp, Burkholderia pseudomallei
atgtccaataccctcatgaacctcggggtcagcggcttgaacgccgcgctctggggtctcaccacgaccggccagaacatcagcaatgcggcgacgcccggctattccgtcgagcgccccgtctatgcggaagcgagcggccagtacacgagcagcggctatctgccgcagggcgtgtcgaccgtcaccgtcgagcgccagtacaaccagtacctgtcgaaccagctgaacgccgcgcagacgcagggcagctcgctgtcgacctactacacgctcgtcgcgcagctgaacaattacgtcggcagcccgacggccggcatcgcgaccgcgatcacgaactacttcaccggcctgcagacggtcgcgaacaacgcggcggacccgtccgcgcgccagaccgcgatgagcaacgcgcagacactcgcgagccagctcgtcgccgccggccagcaatactcgcaactgcgccagagcgtgaattcgcagctcaccgacaccgtcacgcagatcaacagctacacctcgcagatcgcgcagttgaacgagcagatcgcgtcggcgagctcgcaaggccagccgccgaaccagctcctcgaccagcgcgatctcgcggtgtcgaagctctcgcagctcgcgggcgtgcaggtcgtgcagagcaacggcaactacagcgtgttcctgtcgggcggccagccgctcgtcgtcggcaatgcaagctatcagcttgcgaccgtcgcttcgccgtccgatccgagcgagctcacgatcgtatcgaagggcgtcgccggctcggcccagccggggcccacgcaatatctgcccgacgtgtcgctcacgggcggcgcgctcggcggcctgctcgcgttccgcagccagacgctcgatcccgcgcaggcgcagttgggcgcgctcgcggtcagcttcgcgtcgcaggtcaacgcgcagaacgcgctcggcgtcgacatgtccggcaatccgggcggcagcctgtttgcggtcggcgcgccggccgtctacgcgaaccagaacaacaccggcagcgcgacgctgtccgtgtcgttcgtcgacggcacgcagccgacgacgagcgactacgcgctgtcgtacgacggcgcgaagtacacgctgacggaccgcgcgacgggcagcgtcgtcggcacggcgacgccgagctccacgccgccgacgatgacgatcggcggcctgaagctgtcgctgtcgagcacgcccaacgcgggcgattcgttcaccgtgctgcccacgcgcggcgcgctcgacggcttctcgctcgccaccgcgaacggctcggcgatcgcggccgcctcgcccgtgctcgccgcgggcgtcgcgacgaacagcggcacgggcgtgatctcgcagggctcggtgagcgcgggctaccagttgccgtcgggcacgacgacgctcgcgtacaacgcggcgtcgaagacgctgtcgggctttccggtcggcacgacggtgacgatcgcgggcacgccgccgacgtcgatcaacatcacgagcgcgacgacgcccgtgccgtacgatccgtcgaagggtgcgtcgatgacgatctcgagcacgacgcagccggcgccgtcgggcgtgatgaacggcgtgagcgtgtcgctgtcgggcacgcccgcggacggcgaccagttcacgatcggcgcgaacaagggcaccaacgacgggcgcaacgcgctcgcgctgtcgcagctcgtgaactcgaagacgatgaacaacggcacgacgacgctcacgggcgcctacgcgggctacgtgaacgcgatcggcaacgcggcgagccagctgaaggcgtcgagcgccgcgcagacggcgctcgtcggccagatcacgcaggcgcagcaatcggtgtcgggcgtgaaccagaacgaggaagcggcgaacctgatgcagtaccagcagctgtatcaggcgaacgcgaaggtgatccagacggcgaactcggtattccagaccgtgctcggtctcttcaactga

SEQ ID NO: 967 - DNA, 582 bp, Burkholderia pseudomallei
atgaaatcactgtttcgtccgctcatcgtcgtgttcgtcgtgctggtcgccgtcacggggctcgcgtatccggccgtgatgacggtcttcgggcaggccgtgttccccgcgcaggcgaacggcagcctcatcgagaagggcggcagggtcgtgggctccgcgctgatcggccagcagttcgacgcgccgcagtacttctggggccgcctgtcggcgacgagcccgatgccgtacaacgcggcgggctcgggcggctcgaatctcgggccgctcaaccctgcgctgaaggatcaggtgaagagccggctcgacgcgctgaaggcggcgggcaccgatctgtcgcagcccgtgcccgtcgatctcgtgacggcctcggcgagcgggctcgatcccgagatcagcccggccgcggccgactatcaggtcgcgcgcgtcgcgcgtgcgcgcaagatggcggacgccgacgtgcgccgcctcgtcgccgaccacacgtccggccgccagttcggcgtgctcggcgagccgcgggtgaacgtgctgaagctcaatctcgcgctcgacgccgcgcaggccgcgcattga

SEQ ID NO: 968 - DNA, 1392 bp, Burkholderia pseudomallei
ttgaatgacgccatgcctaaccgattccgaccgtttcccgccctgtccgccgttgcggtggcggccgtgttgtccgcctgttcgtcggcgcccaagcctctttatcagcaggaacagttcgacgcgaccacgagcccctacgcgcgcacgttccacgaaaaatcggccgcgacgtgcgaagccgcgcgccgcgcgctgctgagccagggctacatggcgagcgcgacgcgcccggacgcggtcgacggcagcaagaacttccagccgagcaacgattcgcacgtcgtcatcgaatttcacgtcgtctgcgcggaggcggacgtcgacggcgcatcgagcatcgcgtacgtgaacgcggtgcaggaccgctattcgctgaagaagagcaacacgtcggcgagcgtcgggctgagcgtgttcggctcgctgtcgctgccgatcggctcgagcgacgacgcgatggtcaagatcgcgagcgaaaccattccggccggcgtgttctacgagcgcttcttcaatctcgtcgaccatttcctgaagatcgatccgacgcggcgcgacaaggcggccgtcaaggcggccgagaaggagcgcgtcgcgccgctgcccgaaccggcggagacggccgaaggcgcgccgatgaagctgaagacgccggccgcgccgacgccgccggccgcgcccgtgccggcgtcctcggccgcgcccgggacgtcggcgtcgtcggccgtggctgcgccggcggccgcgggttccgggccggccgcttcggcccccgccgcccccgttaggcacgccgcgcctgcgccggcttcggcgacggccgccgcatcggcacccaccgcggcatccgcgccggcgcctacgcccgcgtcggctcccgcgccggcttccacacccgcccccgcgtccgcgccgacaccggcgtccgctccgactccgactcccgcttcagctccgactcccgcttcgattcctgccccggctccagcgtcggccccggcttcaactccagccccggcttcggctccagccccggctccgacaacgaacccggcgtcatcgatcgcgccggcggccgcgccattcgcctcggcgatcccgcctgcgcgcgccgagaagttcgccccggcggtgacggcgacgacagccggttcggcatcgacgccggcctcggccgccgcgccgtcgtcgccgtcgtcgccgtggctgccgcccttgctgccgcccttgctgtcgcccgacgcgccgtcgcccccggcggacaccgcgcggacggcgccgctcgcgccggcggcatcgccggcaaccgccgcggccgcagcgacgaacgccaccgcgaccgccggcgcgatgcaatccgccccccgcgacgacgccgcgacgaactga

SEQ ID NO: 969 - DNA, 1215 bp, Burkholderia pseudomallei
atgttgcgtctttcgctgtccgttctcgtgatttcgctgctcgcggcctgctcgagcgtgccgcccaagtcggcgcgctcgtcgtccggcatggcgatcaccacgccgcgcgcgtacgcgccgccgcgcggctttccgaatttcgtcgaccatagcgtcggccgcgaggaaatctcgatccaggcgatgagcctcgtcggcgtgccgtaccgttggggcggcaacacgcccgacagcggcttcgactgcagcgggctcgtgcgctatgtcgtcgatcgcgcggcgagcgtgaatctgccccgcacgaccgccgacatgagctcgatcggcgaatcgatcgagcccgacggcatcgcgccgggcgatctgatcttcttcaatacgtcggggcggccgcattcgcacgtcggcatctacgtcggcaagctgcgcttcgtgaacgcgccgtcgacgggcggcaccgtgcggctcgactatctgacgaatccgtattgggcgaagcgcttcgacggcatccggcgcgtcgcggcgccgaaggcgaagccggcgccgttcgatgcgccgacctatcaggcgagccggccgccggaacccgcgccgcgcgtgagcccggcagccgcggcgccggcctatgcggcagtcaatgcgccggcggcgtccgccgcacgcgcggcagcgccctccgcgcccggctatgcggcgaactcggcgacgccggccgcggcacgcgccgcagcaccgccgccatcgtccgaatatgccgcccactccgccgctgcgatggcctcagccccggcctcggccgcgccgctgcccaacgccgtgccggctgcggcaaccgccgcaaccgccgccgatccgtacgagccgccgccgtccgcgatgtccgccgcgcgccggcaagcgcaggctgccggcgcgcgttcgcccgtgctcgcggccggcaacccgggcggcgcggtgccgccggccgcgccgcccgccggcggtccgacgagcatggccggcgcatcggcggccgatccgatcgacgccgccgcggacgcgttcgagccgccgccgcccaccgcgcgcgcggccgctcgccaggcgcaactcgccgcgcccggcaacgtgcaggtcctgcgcgcgtcgacagccggcagcgccgcaagcgccgccgcaaccggctcgaacgacgacccgatcgcccgcttcgcgaacggcggttattga

SEQ ID NO: 970 - DNA, 495 bp, Burkholderia pseudomallei
atgaagcttcgaaacctgtcgatcaccgccgccgccttcgcgctcgcattcggcctgtccgcctgcggccagcgcgacgccggcgcgccgcccgccgccgccgcgtccgcatcgatcgcgccggccgcctccgtcacgctcgacgcatccgcgaacgcgagcccgtcggccgcatccgcgcccgccgcgtcgagcgaggcggcgcccgccgccacgacggccgccgccgcggatacgccgaaccccggcggcgagaaggtgttcaagagcgtgtgcttcatgtgccaccagacgggcgcggccggcgcgccgatcgccggcaacaaggacgattgggcgccgcgcatcgcgcaaggcaagccgacgctgtacaagcacgcgctcgaaggcttcaccggcaacaagggcacgatgccgccgcgcggcggcaacccgagcctgaaggacaacgaagtcgaagccgccgtcgacttcatggtcgccaaggcgcactga

SEQ ID NO: 971 - DNA, 966 bp, Burkholderia pseudomallei
ttgaaacgcgaacggcgtgcgcggcgctcccgcctgcccgcggcggcaggcggcctgtggcttgtcgttgccgcgctgccgcccggcgcacgggcagcgacttgcgaaggcgacaagacactcgtcacgcttccggccatcgcggtcgcggccgacgcgccggtgggaacggtgctgtggcgtcagaaggggatcgctttcagcacctattgcacgttgggatggttcgacaccagcaacatttatgtctggcgcgccgacctgcgctcggcgctgcagccatatgggctgacgttctggctgacttacggagggcagggcggcaacaccgcgctgcaaatcaaggagccgatggtcgtcgatctcggcggaaaggccggttatgcgagcggctccgtcgacctggaactgaggaagacgggcgtgacgccggcgcaaggcgtcgtcggcgcggcggacatccccgcgttctatctcgatagcaatacgaactacaacaaaggctcgcactacatccgcgggctgaccaacatttcgttcgtctcctatacctgcgacatcgatacggggtcgcgcagcatgaacgtgccgctcggcgacgtgcgcgtcgatcgcttcagcggcatcggctccaccttcgcggatcggaatttcggcatcggcatgacgtgcacgcagccggccggcacgtacgatatcgcgctgacgttttccgcgacggcggacagctccggcgcaccgggcgtgctcgcgatcacgcagggggcgtcttccgcgtccggagtcggcattcagttgctgatgaacggctcgccggtgactttcggcgccgtcctcgacgcgggcagcgcgaccgcgggcgcgacgctgacgatcccgatgacggcacgctattatcagaccggcagtgtcgtgacgccgggcgcggcgaacgggatcgcaacattcgccgtcagctacaaatga

SEQ ID NO: 972 - DNA, 2586 bp, Burkholderia pseudomallei
atgaacaggattttcaaatcgatctggtgcgaacagacgcgtacgtgggttgcggcatcggagcatgccgtagcgcgcggtggccgcgcgtcgagcgtcgtcgcgtccgccggcggattggagaaagtgctcaagctgtcgattctgggcgcggcatcgctgattgcgatgggcgtggtcggaccgtttgccgaggaggcaatggcggcgaataacgccggtgtgtgtttgacgtacaacggtagtagcaacaatacatcaggtactggcggctggttcgctgatggttgtaaatcggccggctgggtgcagggcatggttacgaatagcaagacggattgggtcgggctgaccgcggacgacacgcagatcgtgctcgacggtagcgcgggcagcatttacttccggacgggcggcataaacggcaacgtgttgacgatgtcgaacgcgaccggcggcgtattgctcagcggcctcgcggccggcgtcaatccgaccgatgcggtcaacatgtcccagttgacctcattgtcgacgtcgacggcaaccggcatcacctcgctttcgacgtcgacggcaaccagcatcgcttcgctttcgacgagcatgctgtcgctcggcgtgggcgtcgtgacgcaagacgcctcgaccggcgcgatcagcgtcggcgccaattcgccgggcctgacggtggatttcgcggggggccagggcccgcgcacgctgacgggcgtcgccgcgggcgtcaacgctacggacgcggtcaatgtcggccagttggcgtcgctgtcgacgagcacggcagcggggctttccactgccgcgagcggcgtcgcgtcgctgtcgacgtcgctgctcggcgcggtgggcgatctggcgtcactgtcgacgagcgcatcgacggggctcgccactgcggatagcggcatcgcgtcgttgtccacgtcgctgctcggcaccgcggacaacgtgacgtcgctgtcgacgagcctcagcacggtcaacgcgaatctggccggcctgcagacctcggtggacaacgtcgtgtcatacgacgatccgtcgaagtcggcgatcaccctcggcggtgcgggcgtcacgacgcccgtcctgctgacgaacgtggctgcggggaagatcgccgcgaccagcacggacgcggtgaacggttcgcagctttacacgctccagcaggagttctcgcagcagtacgatctgctgacgtcgcaagtctcgtcgctcagcacctcggtgtcgggtctccaaggcagcgtctcggcaaatacgggaaccgcgtcgggtgacaacagcacggcgagcggtgacaacgcgaccgcgtcgggcacgaacagcacggccaacgggacgaactcgaccgcgtcgggtgataacagcacggcaagcgggacgaatgcgtcggcgagcggcgagaacagcacggcgacgggtacggactcgaccgcatcgggcagcaacagcacggccaacggcacgaactcgaccgcgtcgggcgataacagcacggcgagcgggacgaacgcatcggcgacgggtgagaacagcacggcgacgggtacggactcgaccgcatcgggcagcaacagcacggccaacgggacgaactcgaccgcgtcgggcgataacagcacggcgagcgggacgaatgcgtcggcgagcggcgagaacagcacggcgacgggtacggactcgaccgcatcgggcagcaacagcacagccaacgggacgaactcgactgcgtcgggcgataacagcacggcgagcgggacgaacgcatcggcgacgggtgagaacagcacggcgacgggcacggattcgaccgcatcgggcagcaacagcacggccaacggcacgaactcgaccgcgtcgggcgataacagcacggcgagcggcacgaatgcatcggcgacgggtgataacagcacggcgagcggcacgaacgcatcggcgaccggtgagaacagcacggcgacaggcacggattcgaccgcatcgggcagcaacagcacagccaacggcacgaactcgaccgcgtcgggcgataacagcacggcgagcggcacgaacgcatcagcgaccggtgagaacagcacggcgacgggtacggactcgaccgcatcgggcagcaacagcacggccaacggggcgaactcgaccgcatcgggcgataacagcacggcgagcggcacgaacgcatcggcgacgggcgagaacagcacggcgacaggcacggattcgaccgcatcgggcagcaacagcacggccaacggaacgaactcgactgcgtcgggcaacaacagcacggcgagcgggacgaacgcgtcggcgacgggtgaaaacagcacggcgacgggtacggactcggccgcatccggtacgaatagcacggccaacggcacgaactcgaccgcgtcgggcgataacagcacggcgagcgggacgaatgcgtcggcgaccggtgagaacagcacggcgacgggtacggcttcgaccgcgtcgggcagcaacagcacggccaacggtgcgaactcgacggcatccggcgcgggggcgacggcaacgggtgaa

SEQ ID NO: 973 - DNA, 939 bp, Burkholderia pseudomallei
atgcgtatcgtcatcgcattgggcggcaacgcgctcttgcagcgcaatcagccgatgaccgaagtccagcagcgcgagaacgtgaagatcgcggtcgcgcagatcgcgcagatcgcgccgggcaacgagctcgtgatcgcgcacggcaacgggccgcaggtcggcctgctcgcgctgcaaggcgcggcgtaccccgcggtcgcgccctacccgctcgacgtgctcggcgcgcagacggaagggatgatcggctatctgatcgaacaggaaatgggcaacctgctgccgcccgacgcgccgttcgcgacgctgctcacgcaagtcgaggtggacccggccgatccggcgttcgagcatccgaccaagccgatcggccccgtctactcgcgcgacgaggccgagcggctcgcgcaggaaaaaggctggcacatcgcgcccgacggcgacaagttccgccgcgtcgtgccgagcccgcggccgcggcgcatcttcgagatccggccggtgaagtggctgctcgagaaaggcacgatcgtgatctgcgcgggcggcggcggcattccgacgcgctacgacgcgaacggcaagctctcgggcgtcgaggcggtgatcgacaaggatctgtgcgcgtcgctgctcgcgcgcgaattgagcgcggacctgctcgtgatcgcgaccgacgtcgacggcgcgtacctcgactggggcaagccgacgcaagcgctgatcgaggccgcgcatccggacgaactcgagcggctcggcttcgcggccggctcgatggggccgaaggtgcaggcggcgatcgaattcgcgcggcagaccggccatgacgcggtgatcggctcgctcgccgacatcgtcgcgatcgccgaggggcgcgccggcacgcggatcagcgtgaaggtcgacgggattcgctaccgccggccgcggtga

SEQ ID NO: 974 - DNA, 1590 bp, Burkholderia pseudomallei
atgaacatcaacacgatttcccatggcacgctccggacgactttgatcgcggccaccgtggcagccatgctctccctctccgcttgcggcggctccggcacgatcagcaagggcctcgacggctcgggctccggcagcggcggcggcaatgcgatttccacgacgggcggctccggctcgggcggcacgagcggcgcgggcggctcgggttcgggcggcagcggcagctccggctcgacgggcggcctgtcgggcggcggcggctcgacctccggcggcggctccacgtcgggcggcggctcgacctccggcggcacgtcgacctcgtcgagcatcaacgcgctcggcacgatcgccggcaacacgggcggcatcatcagcggcgccggctcgaccgtgtcgggcctcggcaccgtcgtcggcagccagacgctgcccggcgtgaacccgcaaacgacgcaagcgctcggcggcatcgtgcaggatctcggcggcgcggtcagcgcgctcggctcgggcgtgacgagcggcatcggccagctcggttcgtcgaccaacccgatcggcacgacggtcgcgagcacgggcggcgtggtcagccaactgggcggcgccgtcacgcagacgggcaacctcgtgacgagcctcggcaccggcccgctcgcgccgctcgccccgctcacgtcgccgctcggcggcgcggtcagcacgctcggcaacacgatcacggcgggcggcacgacgctcaccaccgcgctgtcgacgggccccgtccagcaactgacgcagacggtcagctcggcgatcacgccgatcacgtcgatggtcacgggcacgacgcagacggtcggcaacgtgacgggcctcggcgcgcccgtcaacacgctgctcggcacgatcggcggcgggctgaaccaggccggcgcgctgatctcgaagacgggcaacaacccggtcacgacgggcctcggccaaacggtgtcggcgacgggcaacacgatcacgtcggtcggcggcctgctgacgggcggcagcggcgcgacgaacccgctcgcgccgatcacggccgccgtcggcggcctgacgggcacgctcagcggcgtcagcggcgcaacctcgggcaccccgctcgcaccgctcacgaacgtcgtgtcgacggtcaccggcgcgctctccggcgccaccggcggcgcgacgtcgacgagcccgctcgcgcccatcacgggcctcgtgtcgacggtcaccggcgcactctccggcgccaccggcggtacgacgggctcgaccagcccgctcgcgcccgtcaccggcctcgtgtcgaccgtcaccggcgcgctctccggcgccaccggcggcacgacgtcgacgagcccgctcgcgcccgtcacgaatctcgtgtcgaccgccacgggcgcgctcggcggcgcgaccgccgcgccggcgacgagcacgacgacgagcgcgacgaacccggtcgcgagcctcacagcaccgttgaccggcacgagcagcggcacgagcggcgcgaccaacctgctggcgcccgtcacgtcgctcgtcggcggcctgctcggcggcatcaagaagtaa

SEQ ID NO: 975 - DNA, 1266 bp, Burkholderia pseudomallei
atgacccagcaacgtttcgccccatcgttcgcgctcgcggcctggggcgttccgctcaccgcactcgccaccgtgtgcgtgctcgccgcgtgcggcggcagcgacgtcaccgcgccgccgtccgccggcggcggcacgagcgggaccagcggcacgagcggcacgagcggaaccagtggcacgagcggcaccagcggcacggcgggcacgtcgggcgtcgtcaacacgctcggcaagacggcgaccgatctcggcaacacgatcagctcgacgagcgtgccgggcctcggcagcggcgtgacgcagggcgtcggcgcgacggtcggcagcacgggcggcatcatcaacgccgcggcggatgcgctcagcaacggcctcggccagaccggctcgacgcagaacccggtcggcacgacggtcgcgggcctcggcaacgtcgtgagcgcgacgagcaacaccgtgcagggtctcagccagaccgtgcaagcgctcggcacgggcccgctcgcgccgctgtcgcccgtcacgacgcctgtcgcgggcgcgctcgcgacggcggccaacggcgtgaacgcggccggcacgatgctcggcaacgcgctgtcgacggggcccgtccagcaagtcacgcagccgatcagctcggcgctcacgccgctcgtcatcacggcgggccaggtcacgcagacggtcggcacgacgacgggcgtcggccagccggtgtcgggcctgctgcagcaagtcggcggcgcgatcagctcggccggcacgcagatcgcgggcacgtcgccgtcgcagccgctcgtcggcgacgtcggccagctcgtgtcggcggtcggcaacaccgtgacgaacgcgggcggcctcgtgaacccggccgcgccgaacggcgcggcgccgatcccgggcctcatcacgagcgtcgtcggcggctcgacggcgacggtcgccaccggctccagttcgggctcgacgctcggcagcccgctgaacggcctgctgtcgagcctcggcggcggcgccctgccgagcggcccgctcggcggcagcgcggtgtcgggcggcgcgagcaacccgctcgcgccgatcacgagcctcgcgagcggcggcacgggagctagtacaaacccgctcgcgcccgtcacgggtttgctcaatactgtcaccggcacgctgtccggcgcgacgtcgtcgacaggcggctcgacggggctcctcgctcccgttaccggttcgctcggcacgctgggcagctttggtaagtga

SEQ ID NO: 976 - DNA, 2121 bp, Burkholderia pseudomallei
ttgcgctcgtgcgccggaaccgctgtcacgctcgccgttctgagtgcgggatgcgcggaatcgacgcccaaatccggcaacggcggcgccgcgtcgacggcgatcgagcgcacgaaagccgatcgtctcgcgcgcgaacagcagaccgcgcggaccgtgccgacgctcgcgtcgatcaaggtcgaccagccgcgcccgctcacgctgcgcgattcaggccaaagcggcacgctcgcgttcctgcgcgaagtcgatttccgcatcgtcggcgatctcggcttcctcgttcacgagctgtcggcgacgctcgtgccgacgcatcccggcgcccccaccgtgttcgatgatccgacgagcttcgacatcgccgtgcaccgcggcaccgtgacgctcgacaacaccaaactcaatgcgctgttcggcggctacatcttcggctatcgcaacgcgccgttgcgcaacgtgcgcgtgagcgcgggcgacggcttcctcgacatccgcggcgaaatgcagcgcgacggctgggtgccgttcgcgctcaaaggcaagctggagatccgcgacggctcgacgctcgtgttccacccgaccgacgtgcacgtatcgggcatcgaagcgggccccgtgatgcgcgcggcgaaagtgcaggtgtcggatctgctgaagatcgatacgccgatcgtgcggctgaacggcaacgatctcgtgctcaacgtcgacaagctgctgccgccgccccatctgaagatcaatatcgtctcgctgaaactgacttccgccggcctcgatctcgtgctcgacgacggcacgaaggcgggcttcacgatgccggagaacgcgccgaagcatgcaatgtatctgcgcggcggcgacgtgaaattcatgcgcacgatgccgatgaacgcggacatcgtgatctacccgccgcgcgaatcgtcgcccgacgacgcattcgtattcgacatgtatcactatcgcgatcagctcgtcgccggctatttcaacttcgagccgagcggcgcgctgtcgattctgatgccgtcgtatcggcggctcgcgcgcccgagcgcgccgagcctcggcagcgcggccgcgcggatgaacgacagcctgatcgacgcgcagcagttaagcctcggcgaagcgcgccgccaatgggaggcgttcgcggtcacgccgaacggcggcgcggcgcagccgaacttccgcaaggtggccgccaagcacggcggcgatgtatcgatgttcggcccgcgccatatttcgaacggcacgacgacgatccacctgcacaacgcggacttctacattgcgggcaatatcggctttcgcgtcgaggatctcgtcgtccagctcgtgtcgaagcgcgcgggcgagcccgtcgatctcgacgatccgaaccagtacgacatccgcattctgagcggctcggtgctcgcgccgtgggatgcgatgtccgacctcttcaaccgccacctgctcgactattcgccgcgctcgctgaacgacctgaagctgagcgccgacggcggcgcgctgcgcgtgcggggcggcatcaagctgtggaatcaggtgccgcccggcgtctggctgccggccgacatgaagggttcgctcacactgctggacgaacgccatctcgcgttcacgccgacgcaggtatcggtgctcggcataccgcaggcgaagctgctgcgcgcactcggcatcgagctgtcgtcgctcgcgccgctcaagcgccgcggcgccgagctgcgcggcgattcgctcgtgctcgaccagtacaccgtgttcccgccgcccgtgctgatcggccacatgtcgcaggcgacagtcgagccggacggtctgcgcctcacgttccgccccgcgccgaacgcaccggtgctgcggccgccggcgaaccttcccggcagctacctgtggctcgaaggcggcgacacgaagatgttcaacgtcctcgtgctgaacatgcgcattctcgtcgaggacacggccaagccacgggtgcgcttcgatctctacgattaccgtgacgtggtctcgcgcggctcggtgcggatggtgcacgatgggacgctgtacgtcgacgtcggcaagaaggatccgctcgcccgatga

SEQ ID NO: 977 - DNA, 561 bp, Burkholderia pseudomallei
atgaaggctcactggaaagtctgggcggctctcgcttgcgtgtccgcctgcgcgggcgtgcaggcgcagaccagcccgctcacggggacggtcaactcgcagctcgtgctgacgacgggctgcgcggtcgatacgggcggcggctcggtgaactcggcgaacttcggcacgctcgacttcggcacgcagccgagcggcttcacgggccggctcacgagcgcggcgaagggcggcggctcgacgtcgacgcaagtgacctgctcgcctgacgtcacgtcgatccaggtgacgatcgacggcggccagaacgcgtcgaagggtgcgaccgtcggcacgggcacgcgcgcgctcgcgaacggcgcgagcttcgtgccgtacgaagtctacgcggatgcggggcattcgcaacagtacgtgtcgggcacggcgcaatcggtcgcggtgccgacacccggcgccgcattcgagctgccgttgtacggcgtcgtcaacaagacgaacgcgtcggcgctcgctgccggcacctataccgacgtgctgaacgtcacgctcggctggtaa

SEQ ID NO: 978 - DNA, 549 bp, Burkholderia pseudomallei
atgaagaccgtgggcgataaactcgaagctttcaccgttgtggccgcgaagccgggcttcaacaatcacgaagaaaacggccagtcggcattcgagaccgtcaccgaagcgtcgttcccgggcaagtggaagatcatctacttctacccgaaggacttcacgttcgtctgcccgacggaaatcgtcgaattcgcgaagctcgcgaagcagttcgaagagcgtgacgccgtcctgctcggcggcagctcggacaacgaattcgtcaagctcgcatggcgccgtgagcacaaggatctcgacaagctgaaccactactcgttcggcgacgtcaagggcgagctgatcgaccagctcggcgtgcgcgacaaggaagcgggcgtcgcactgcgcgcgaccttcatcgtcgatccggacaacacgatccagcacgtgtcggtgaacaacctgaacgtcggccgcagcccggaagaaatcctgcgcattctcgacggcctgcaaacggacgaactctgcccgtgcaaccgcgcgatcggcggcgcgacgctgtaa

SEQ ID NO: 979 - DNA, 597 bp, Burkholderia pseudomallei
atgcaaaaacgattcaagcaactggtcctgctggcggcgatggttccggcattcgcgatggcgcaatcgctgtcgaaccagacttcggctccggcggccgctgctccgatcgacgcggacaagaaggcggcgatcaaggatctgctcgacgcaatcgacgcgccgaagctcgtgtcggcgatcgcgaacagcgccgagatgcaatcgaagcaactcgtgccggcgatcctctcggacgcgctgtcggagaacaagacgctgaacgacaagcagaagcaggccgccgtgccgacgctgcagaagaacgcggtgccgaagctggtcgacggcgcgggcaaggtgttcggcacgcagcagttcacgaacgacgcgatgcaggctcagtacgacgcgtacgcgaagtactacagcacgtcggagatcaaggatctgacgacgttctacaagagcccgacgggccgcaagttcatccaggtccaggaccaggtcggccgcgacgtcgtgaacggcctgatgcagaagtacatgccgcaggcgatcaaggcgacgcgcgaccaggccgacaaggaagtcgcggcggtcaagccgggcaagtaa

SEQ ID NO: 980 - DNA, 675 bp, Burkholderia pseudomallei
atgaataaactttcaaagctcgcgttcattgcagctaccgcagttatggctgcatccgcttcggcacagtcggtgccggcgtcgcgacaagccgtgaatgacaactgggtgaatggcacgggcgaatgggtgtggatgaacggcacgaacgagctctgctggcgcgatgcgttctggacgccggccaccgccaacgccaagtgcgatggcgcactggtcgcccaggcaccggcaccggcgccggtcgcaccggttgctccggccatcacgagccagaagattacgtaccaagccgatacgctgttcgacttcgacaaggccgtcctgaagccggccggcaagcagaagcttgacgaactggccgcgaagatccagggcatgaacgtcgaagtggtcgtggccacgggctacacggaccgcatcggttcggacaagtacaacgaccgtctgtcgctgcgccgcgcgcaagccgtcaagtcgtacctcgtcagcaagggtgtcccggcgaacaaggtctacacggaaggcaagggcaagcgcaacccggtcacgggcaacacctgcaagcagaagaaccgcaagcagctcatcgcctgcctcgcaccggaccgccgcgtggaagtcgaagtggtcggcacgcaggaagtgcagaagacgaccgttccggcgcagtaa

SEQ ID NO: 981 - DNA, 1641 bp, Burkholderia pseudomallei
atggcagctaaagacgtcgtattcggcgattccgcacgcgcgaagatggtcgaaggcgtgaacattctcgccaacgctgtgaaggtcacgctgggtccgaagggccgcaacgtggtgctcgagcgcagcttcggcggcccgacggtcacgaaggacggtgtgtcggtcgcgaaggaaatcgagctgaaggacaagctccagaacatgggcgcgcagatggtcaaggaagtcgcttccaagaccagcgacaacgccggcgacggcacgacgacggccaccgtcctcgcgcaatcgatcgtccgcgaaggcatgaagtacgtcgcatcgggcatgaacccgatggacctgaagcgcggcatcgacaaggcagtcgccgcggcagtcgaagagctgaagaagatcagcaagccgtgcacgacgaacaaggaaatcgcgcaagtcggcgcgatctcggcgaacagcgattcgtcgatcggcgatcgcatcgctgaagcgatggacaaggtcggcaaggaaggcgtgatcaccgtcgaagacggcaagtcgctcgccgacgagctcgacgtcgtcgaaggcatgcagttcgaccgcggctacctgtcgccgtacttcatcaacaacccggacaagcaagtcgccgtcctcgagaacccgttcgtgctgctgcacgacaagaaggtgtcgaacatccgcgacctgttgccggtgctcgagcaagtcgcgaaggctggccgtccgctgctgatcatcgccgaagacgtcgaaggcgaagcgctcgcaacgctggtcgtcaacaacatccgcggcatcctgaagaccgttgcggtcaaggcgccgggcttcggcgatcgtcgcaaggcgatgctggaagacatcgcgatcctgacgggcggccaggtcatcgcggaagaaaccggcctcacgctcgagaaggcaacgctggcagaactgggccaggcgaagcgcatcgaagtgggcaaggaaaacacgacgatcatcgacggcgcgggcgaagccgtgaacatcgaagcgcgcgtcaagcaaatccgcacgcaaatcgaagaagcgacatcggactacgaccgtgaaaagctgcaagagcgcgtggccaagctggcaggcggcgtggcggtgatcaaggttggcgctgcgaccgaagtcgaaatgaaggaaaagaaggcacgtgtcgaggacgcgctgcacgccacccgcgctgccgttgaagaaggcatcgtcccgggcggcggcgtcgcgctgatccgcgcacgcaccgcgatcgcgggcctgaccggcgtgaacgccgaccagaacgccggcatcaagatcgtgctgcgcgcgatggaagagccgctgcgccagatcgtcacgaacggcggcgaagaagcgagcgtcgtggtggcggcagttgctgcgggcaagggcaactacggctacaacgcggcgacgggcgagtacgtcgacatggtcgaagccggcgtcgtcgatccgacgaaggtcacccgtaccgcgctgcagaacgcggcttcggtcgccggcctgctgctgacgacggacgcagccgttgccgaactgccgaaggaagacgctccgatgccgggcggcatgccgggcggcatgggcggcatgggcatggacatgtaa

SEQ ID NO: 982 - DNA, 294 bp, Burkholderia pseudomallei
atgaaccttcgtccgttgcacgatcgcgtgatcgtcaagcgcctggatcaggaaaccaagaccgcctcgggcatcgtcattcccgacgcagccgctgagaagccggatcaaggcgaagtcctggccatcggcccgggcaagcgcgatgacaagggcgctccgatcgcactcgacgtgaaggtcggcgatcgtgttctgttcggcaagtacgctggccaaaccgtcaaggtcgacggccaggaactgctcgtgatgcgcgaagaagacatcatggccgtggtcaacgctaagtaa

SEQ ID NO: 983 - DNA, 513 bp, Burkholderia pseudomallei
atgatgtcgaagaaacttcgtctggcgttcgcgatgctgatgatcggcgcgctcgcggcatgcaagtcgggcgtgaagctcgacgagcacgcgaaccagggcgacgcggtcagcacgcaaccgaatcccgaaaacgtcgcgcaggtgaccgtcgatccgctgaacgatccgaacagcccgctcgcgaagcgcagcgtgtacttcgatttcgacagctactcggtgcaggaccaataccaggcgctgctgcagcaacacgcgcaatacctgaagagccatccgcaacgccacatcctgatccagggcaacaccgacgagcgcggcacgagcgagtacaacctcgcgctcggccaaaagcgtgcggaagccgtgcgccgcgcgctgtcgctgctcggcgtcggggatgcgcagatggaagccgtgagtctcggcaaggaaaagccggttgcgctcggccacgacgaagcgtcgtgggcgcagaaccgccgtgcggacctcgtctatcaacagtaa

SEQ ID NO: 984 - DNA, 318 bp, Burkholderia pseudomallei
atgcatgttcgtcccctctacgaccgggttatcgtcaagcgaatcgaacagcagcggacgacggcctcgggcatcgtgattcccgactcggccgccgaaaaacccgaacagggcgaaatcgtcgcgcttggcaacggccggctgctgcaggatggaacgcttcgcgcgctccagctcgaagtcggcgaccaggtcattttcggcgagtacgccggccagagcatcaaggtcgacggcgaggacttcctcgtcatacgcgaggaggacgtgctgggcgtgctcgaagccggcgagcgcgccgcgcgcaaggccgcctga

SEQ ID NO: 985 - DNA, 660 bp, Burkholderia pseudomallei
atgagccttggactcgtaggtcgcaaggttggcatgacccgtatcttcacggcggaaggggattcgattcccgtcaccgtgctcgacgtgtcggacaaccgcgtgacgcagatcaagactgttgaaaccgacggctacacggccgtgcaggttgcattcggctcccgccgcgcgtcgcgcgtgacgaagccgctggcaggtcatctcgccaaagccggtgtcgaagccggtgaaatcctcaaggaattccgcatcgaagccgacaaggccgccgagctgtcgaacggcgccgtgatcggtccggatctgttcgaagtgggccagaaggtcgacgtgcaaggcgtgtcgatcggtaagggctacgcgggcacgatcaagcgctacaacttcggctccggccgcgcatcgcacggtaactcgcgctcgcacaacgtgccgggctcgatcggtatggcgcaggatccgggtcgcgtgtttccgggcaagcgcatgacgggtcacatgggtgacgagacggtgacggttcagaacctggaaatcgctcgcatcgacgccgatcgcaagctgctgctcgtcaagggtgcagttccgggtgcgaagggcggcaaggttttcgtgacgccggccgtgaagacgcgtgccgtgaagggggcgaaataa

SEQ ID NO: 986 - DNA, 1404 bp, Burkholderia pseudomallei
atgtcggacgccttttcgaaaggggtggcaatggccatagccgtcgcccctttgtttgccgcttgtagtggagggggcggcggcaccccggcccccatcgccgtgccgcaatgctccggttcgagctgcggcgttcagggtccgcccagctcgacggcggccaacacttcgctgtgccccgccgacgcgaacatcggcagcagcacctatctcggcggcgccggcggcggcgagatcgtgagcctgaacatcaacgcgaccacgatgacgtacacgctcaagtggctcgagtcgccggttccgctcgccaccggcaccgtcacgccgacccgcgccggcacgacgatcacgggcagcgtcgcgcatccgcccgcgggcacgctgccgaccgccgagcagacgcgctgcgcgttcgtgctgctgcccggcagcggcacggcgcccgcgacgaattcgacgtactcgaccgcggccgacttcaaccaggcgaacccgccgatgatcctgatcggcttcgacgtcgcgggcggcggcattccgggcgcgacgatccagtacagcggcctcacgatcatcccgggcgtgctgcagaacatcggccaggtgccgcagcgccatttcgacttctatccgttcctcggcttcgcgaacacgacgaccgatctgtcgaagctgccgggcacgtacaacgccctcgtctatcacacggtgccgtcgggcaactacgcggcgaaggcgatcgcgtcgaacgagacgttcgatgcgaacggcgcgtgcacatcgacgagcgcatcgggctgcatgacgaccggcaatccgtggacggcgagcggcaacggctacttcaacagcacgcaggcgccgcagatcctgccgcagacgcagttgccgctcatcggcgcgaccggcaaatcggccgtcgcgcacatggtgctcggccagttgaacggcgcgaccgtgcctgtcgtcgtgcgcacgggcaacgtgaatctcggcacgccgccgctgcacaccgatgcgcaggtggacgacgaatcgggcatcgcggtgctcgggctcgcgcaggcgatcgcgtcgggcggcatcgacggcggctacgcgggcgcggactcgaacttcaagtacacggcgacggtgatcaagggcacgacgggcacgttcgtgaacccgagcacgcagcaggccgagacgggcttcacgctcgactacggccagtcgacgccggggctgctcggcgtcacgacgaccgacacgtcggcgccgggcttcgtgatcgcgagcggcgggctatatgcggcgctggtccagggcaccgtcaacggcggcatcacgcagagctcggcgatcgccggccagacgccgtccgcgccctacttcggcgtaggcgcgcaagtcagcaagtaa

SEQ ID NO: 987 - DNA, 1167 bp, Burkholderia pseudomallei
atgctcggaatcaacagcaacattaactcgttggtcgctcaacagaacctcaacggctcgcaaggcgccctgtcccaagcgatcacccgcctgtcgtcgggcaagcgcatcaacagcgcggcggacgatgcggccggcctcgcgatcgccacccggatgcaaacgcagatcaacggcctgaaccagggcgtgtcgaacgcgaacgacggcgtgtcgatcctgcaaacggcatcgagcggcctgacctcgctcaccaacagcctgcagcgtatccgccagctcgccgtgcaggcctcgaacggcccgctgagcgcgagcgacgcgtcggcgctgcaacaggaagtcgcgcagcagatctcggaagtgaaccgtatcgcttcgcagacgaactacaacggcaagaacatcctcgacggctcggcaggcacgctgagcttccaggtcggcgcgaacgtcggccagacggtctccgtcgacctcacgcaaagcatgtcggcggcgaagatcggcggcggcatggttcagacgggccagacgctcggcacgatcaaggtggcgatcgactcgagcggcgcggcctggtcgtcgggcagcaccggccaggagacgacgcagatcaacgtcgtgtcggacggcaagggcggcttcacgttcaccgatcagaacaaccaggcgctgtcgtcgacggccgtgaccgccgtgttcggctcgtcgaccgccggcacgggcacggcggcctcgccgtcgttccagacgctggcgctgtcgacttcggcaaccagcgcgctgtccgcgaccgaccaggcgaacgccacggcgatggttgcgcagatcaacgcggtcaacaagccgcaaacggtctcgaacctcgacatcagcacgcagacgggcgcgtaccaggcgatggtatcgatcgacaacgcactcgcgacggtcaacaatctgcaggcaacgctcggcgcggcgcaaaaccgcttcaccgcgatcgcgacgacgcagcaagccggctcgaacaacctcgcgcaggcgcaatcgcaaatccagagcgcggactttgctcaggaaaccgcgaacctgtcgcgcgcgcaagtgctccagcaagccggcatctcggtgctcgcgcaagcgaactcgctgccgcagcaagtgctgaagctcctgcaataa

SEQ ID NO: 988 - DNA, 1542 bp, Burkholderia pseudomallei
atgcaactcaatccctctgagatcagcgagctgatcaagagccggatccagggccttgaagcgagcgcagacgttcgcaaccagggcaccgtgatctccgtgaccgacggcatcgtgcgcattcacggcctgtcggacgtgatgcagggcgaaatgctcgagttcccgggcaacacgttcggcctcgcgctgaacctcgagcgcgactcggtcggcgcggtgattctcggcgaatacgaacacatctcggaaggcgacatcgtcaagacgacgggccgcattctcgaagtgccggtcggcccggaactcgtcggccgcgtggtcgacgcgctcggcaatccgatcgacggcaagggcccggtcaacgcgaagctgaccgacgcgatcgagaagatcgccccgggcgtgatctggcgcaagtcggtgtcgcagccggtgcagacgggcctgaagtcgatcgactcgatggtgccgatcggccggggccagcgcgagctgatcatcggcgaccgtcagtgcggcaagaccgcggtggcgatcgacacgatcatcaaccagaagggcaaggacctcatctgtatctacgtcgcgatcggccagaaggcttcgtcgatcatgaacgtggtgcgcaagctcgaggaaaccggcgcgctcgaatacacgatcgtcgtcgccgcgtcggcgtcggaatcggccgcgatgcagtacctcgcgccgtacgccggctgcacgatgggcgaatacttccgcgatcgcggccaggacgccctcatcatttacgacgacttgaccaagcaagcttgggcgtatcgtcagatctcgctgctgctgcgccgcccgccgggccgtgaagcgtacccgggcgacgtgttctatctgcactcgcgactgcttgagcgtgcggctcgcgtgtcggaagagtacgtcgagaaattcacgaacggcgaagtgaagggcaagagcggctcgctgacggcgctgcccgtcatcgaaacgcaggcaggcgacgtgaccgcgttcgttccgacgaacgtgatctcgatcaccgacggccagatcttcctggaaaccgatctgttcaacgccggtatccgccccgcgatcaacgcgggcgtatcggtgtcgcgagtcggcggcgccgcgcagacgaaggtcgtgaagaagctgtcgggcggtatccgtaccgacctcgcgcagtatcgcgaactggccgcgttcgcgcagttcgcgtcggatctcgacgaagcgacccgcaagcagctcgagcgcggccgccgtgtgacggagttgctcaagcagccgcaataccagccgctgcaggtgtgggagctggccgtgtcgctgttctcggcgaacaacggctatctcgacgacctcgacgtcaaggacgtcctgccgttcgagaagggcctgcgcgagtatctgaagacgagccacgctgacctcatcaagcgcatcgaagacacgaaggacttgtcgaaggacgacgagagcgcgctgcacgccgcgctcaaggacttcaagaagtccggtgcctattga

SEQ ID NO: 989 - DNA, 1938 bp, Burkholderia pseudomallei
gtgacgccgcgagcggcacttgtcacgcttcttctcgcggcatggtctgcgccgagcgttgcgcaagcactccaccctggatcgggggcgcagagtgttgaagtgggggcgggatcgaacgcatcgggttcgcaaagcaccgcactgggtaacggtgcgcaggcgacgggcagtcatagcacggcaacgggccaaggctcgcatgcgacgggtagtaacagcacggcaacgggtcaggatgctaacgcgtcgggcacatcgagcacggcgacgggccaaggttcgcaagcgacggggaacaacagcacggcaacgggtcaggatgccaccgcgtcgggcacatcaagcacggcgacgggccaaggttcgcaagcgacgggtagcaacagcacggcaacggggcaggatgccaccgcgtcgggtgaatcgagcacggcaacgggccaaggttcgcaagcgacggggaacaacagcacggcaacggggcaggatgccaccgcgtcgggcacatcaagcacggcgacgggccaaggttcgcaagcgacgggcagcaacagcacggcaacggggcaggatgccaccgcgtcgggtgaatcgagcacggcgatgggccaaggctcgcaagcgacggggaacaacagcacggcaacggggcaggatgccaccgcgtcgggtgaatcgagcacggcgatgggccaaggctcgcaagcgacgggcagcaacagcacggcaacggggcaggatgccaccgcgtcgggtgaatcgagcacggcggcgggccaaggctcgcaagcgacgggcagcaacagcacggcaacgggtcaggatgctatcgcgtcgggtgaatcgagcacggcgacgggccaaggttcgcaagcgacgggtagcaacagcacggcaacggggcaggatgctaccgcgtcgggtgaatcgagcacggcgacgggccaaggttcgcaagcgacggggaacaacagcacggcaacgggtcaggatgccaccgcgtcgggcacatcaagcacggcgacgggccaaggttcgcaagcgacgggtagcaacagcacggcaacggggcaggatgccaccgcgtcgggtgaatcgagcacggcgatgggccaaggctcgcaagcgacgggcagcaacagcacggcaacggggcaggatgctaacgcgtcgggtgaatcgagcacggcgacaggccaaggtgcgcaagcgacgggggacaacagcacggcaacgggccaggatgccgccgcgtcgggtgaatcgagcacggcgacgggccaaggctcgcaagcggcgggcagcaacagcacggcgaacggcgccggtgccgccgcgaccggacaccagagcactgctctgggcgcgggcgctcaagccgctggctcacagggcgtcgcgagcggctggaacgcaaacgcgtcggggactcaaggcgtcgcaatcggcggcaatgcctcggcgcagggcaatcaaagcatcgcgctcggagccaatgcgtcggcgacgggcgaccacagcatcgcgttgggcgccggctcgcaggcaacgggctcgaactcggtcgcgctgggccaggggtcgatcgcggaccgcgacaactcggtttcggtgggttcggatggcggtgagcgcaacgtcaccaatgtggcgaatggatggcacgataccgacgccgtcaatttccggcaactgcgcgaggtcgcgcgctacgcatacagcggcatcgctgccgcaactgcgctggccatgattccggacgtcgacgcaggcaagacgttttcgatcggcgtcgggacgggcggctacctcggctatcaggctgtcgccgtcggcgcgtcggctcgccttggacaaaatctgaaggtccgggtgggcgcgggcattagcgcggcgtcgacgacatggggcgctggcgcatcgtatagctggtag

SEQ ID NO: 990 - DNA, 546 bp, Burkholderia pseudomallei
gtgaaaaagaaggtcgtaagtttcgccgttgcgacattgtttggccttgttgcagcgcagagcgtgtatgcacagtcgatcgatcaggggcaggtcaaattcacgggtgagctgaccgccaacacgtgcacgatcgacgccggcagcaaagaccaaatcgttcccttgccgaaagtttccacgagcgctctggcggcgccgggagatgtcgctggttcgacggcctttgaaatcaaggtgtcgaagtgcgctgcggatgtcaagaaggtcgccgctcacttcgagatggaaaacatggaccccaacacgcgtacgttgaaaaacgaggccacgggaacggacgccgcgacgaacgtgacgattcaactggtcaactccgatggcaccgaactgccggtaggttcgaccggtagttacttcgacgtcaccggaaccgacgatgcgcgtggggcaaccatgatctatggcggccagtactacgcgttggatacaaccaccgcgggtaaggtcgagtcgcacacgctcttcacgcttgcctacgaataa

SEQ ID NO: 991 - DNA, 1029 bp, Burkholderia pseudomallei
atgaagaaaaaattctcaagattccttgcggccctcgtcttgctcgcagcgaccgtcgatgcgcttgccgccggctgcaacatgctgaccgcggagaatatcgcgtggctgaccgagcaaggcaagatcgcgcgcgctcacagttcctttcccatatccttctcttccggaatggtcgatgtcgacccgaacctcgagatcggaggcttgatagcagaggcaaaaagcatcccaagcgaagaactgcacttcatttggtgcagcgcgccctccgggaatgttcactttgcgctcaattcgtccccgctgccgtcggaactcggaaattcgatctatgaaaccggtgtgcccggcgtcggattccgaatcactcaggttcgccagagcggctcgataggggcgattcctcgcgatacgccgtggatcgaagaaaagcccggccaggacagctctctgaatttcggcgcgggaaccgtgttccgtatcgagctgatcaagaccagcgaagcgttgccgagcgaatcgaccatatcccttggcaacctcagtcgcgtatacggtgacgacaacaaaacggtcgtcgatttcaatgccggcagcgtcaagttgcgcgtgctgccgatctgccatgtcgatcaacaggaaaaaaatgtagatttcggccaattcggcccgaaagacgtttccttcgattccggccccaccaaggacgtcaagtttgacgtccagtgttcgggcccgacgccccccgtctccatcacggcgactttggccgcgacgccggatagtcacgatcaaagcctgatcgcgaacgccggcgatgccatgaaccttgccatccgattgcgcgatgcaagtacgcaacaggttctcaggcccaacgatcccaccagcgaaatcaaggtcgagcccggcggcgcaatggagcacggattcgcactggaggcgactgtcctgcgtgtcggcacggcgccgcccacggcgggcacgatcgacgcaacctcaatcatcacgctaaccattttgtga

SEQ ID NO: 992 - DNA, 1176 bp, Burkholderia pseudomallei
gtgaaacgcctgtttctgattctgatcctcgtgccgacgatgttcctcgcggccggctgcgataacgtcccggccggctacgtcggtgtgaaggtgcaacgctacggcgacgaccgcggcgtcaacgtcgaagtgaaggggcccggtcgctacttcaacgggcccaacgtcgacatgttcatcttcccgacgttcacgcagtcctacgtgtgggacaaagctggcaagtccgacgagtcgttcacgttccagacggtggagggcctgtcggtcaacaccgacatcggcgtcagctacgcgatcccgcgtgagaacgcgcccaaggtgttccagaagtatcggcgcggagtagatgagatcacgggcgtctacctgcgcgcgatcgtgcgcgacgccctgaatctcgccggcgcgtcgatggcggtcgaggacgtctacggcaggggcaaggcggcgctacagcagcgcgtcgaggacgaggtaaaggcgaacgccgcgaaggtcggaatcagtgtcgagaaggtctatttcgtgaatcagatgcgcctccccgagcaggtcatgaactcgatcaacgggaagatcgctgcgacgcagatcgcgcagcagaaggagaacgaactgcgtgcagccgaggcggacgcggcaaagcaagtcgcgatcgccaagggcgaggccgaagcgctcgaggtgaaagcgaaagcactacgcgagaacagccagatcctgcaacagatggcgatcgagaaatgggacggcaagctcccccagtacgcgcgccgcgcggtgggctgggcgtttagtcagcacgcggacaccgacttggcactaaaggcattaagacgggcttacgatcatcgtcgtccgccaccaggcctgatgttccattcggatcagggctgccaatacacgagcacgcgctttctcgccgagctgcgcgcccgtggcacgatccagagcatgagtcggcgcggcaactgttgggacaacgcggtggtcgagcgcttcttccgaagcctcaaaaatgaatggatcggcgaccagttgtacgtcgatcaccgccatgcagagcaagacatcactgattatctagtcgatttttacaaccatcgtcgccttcactcggctgcgaagggacttcgacagacgtatcgatttggtgttcaaggccagtga

SEQ ID NO: 993 - DNA, 291 bp, Burkholderia pseudomallei
atgagcctacgcccgctacacgatcgcgtcatcgtcaagcgactcgatcaggaaaccaagaccgcctcgggcatcgtgattcccgacagcgcggcggaaaagcccgatcagggcgagatcgtcgcggtcggccccggccggcgcgacgccgacggcaagcgcgtcgagcccgacgtgaaggtcggcgagcgcgtgctgttcggcaagtatgccgggcagtccgtgaaggtcgacggcaacgaactgctggtgctgcgcgaagaggacatcgtcgcagtcgtacattcctga

SEQ ID NO: 994 - DNA, 1641 bp, Burkholderia pseudomallei
atggcagcgaaagagatcattttccacgacggcgcgcgcgcgaagctcgtcgaaggcgtcaatctgctcgcgaacgcggtgaaggtcacgctcgggccgaagggccgcaacgtcgtgctcgagcgcagcttcggctcgcccgtcgtcacgaaggacggcgtgtcggtcgcgaaggaaatcgagctggcggacaaagtgcagaacatcggcgcgcagctcgtgaaggaggttgcgtcgaagacgagcgacgcggcgggcgacggcacgacgaccgcgaccgtgctcgcgcaggcgatcgtgcgcgaagggcagaagtacgtcgccgcgggcctgaatccgctcgatctgaagcgcggcatcgacaaggcggtggccgccgccgtcgacgagctgaagaagatcagcaagcccacgacgacgagcaaggagatcgcgcaggtcgcgacgatctcggcgaacggcgaggaatcgattggccagcgcatcgccgaggcgatcgaccgcgtcggcaaggaaggcgtgatcaccgtcgaggacggcaagtcgctcgccgacgagctcgacgtcgtcgaagggctgcagttcgatcgcggctacctgtcgccgtacttcatcaaccatcccgagcgccagctcgcggtgctcgacgagccgttcatcctgctgcacgacaagaagatctcgaacatccgcgatctgctgccggtgctcgagcaggtcgcgaaggcgggccggccgctgctgatcgtcgccgaggacgtcgagggcgaggcgctcgcgacgctcgtcgtcaacaacatccgcggcatcctgaagaccgtcgcggtcaaggcgccgggcttcggcgaccgccgcaaggcgctgctcgaggacatcgcgatcctcacgggcggccaggtgatcaccgaggaaaccggcctcacgctcgagaaggcgacgctgcaggagctcggccgcgcgaagcgcatcgaggtcggcaaggagaacacgacgctcatcgacggcgcgggcgacaagccgaacatcgatgcacgcgtgaagcagatccgcgcgcagatcgccgaggcgacgtccgactacgatcgcgagaagctgcaggagcgcgtggcgaagctcgccggcggcgtggcggtgatcaaggtcggcggcgcgaccgaagtcgaggtgaaggagaagaaggaccgcgtcgacgacgcgctgcacgcgacgcgcgcggccgtcgaggaaggcatcgtgccgggcggcggcgtcgcgctgattcgcgtgaagcaggcgatcgcggcgctcgcgggcgcgaacgccgaccagaaggcgggcatcagcatcgtgctgcgcgcgctcgaggagccgttgcgccagatcgtcgcgaacgcgggcgaggaggcgagcgtcgtcgtcgcgacggtcgcggcgggccagggcaactacggctataacgcggcgacgggcgaatacggcgacctcgtcgaatcgggcgtgctcgatccgacgaaggtcacgcgcaccgcgctgcagaacgccgcgtcgatcgccggcctgctgctcacgacggatgcgacggtgcacgaggcgccgaaggatgcgccgcccgccgcgccggcgggcgtgccgggcgcgggcggcccgggcttcgatttctga

SEQ ID NO: 995 - DNA, 1362 bp, Burkholderia pseudomallei
atgagtagtctgccggtaggaccggtcgcgtggagcgacggcatgctgatcgagacgcagcacttccagcagctcgagcggcatctcgcgcatcaggcctcgctgcggctcggtcagacgtcgaatcacggctggggcttcacgctgctcgatctcgaccaggacggcctggggctcggccggctcgggctgcgccacgcgcgcggcgtgttccaggacggcaccgcgttctcgctgccgtcggacgatccgctgccgccgccgctggaaaccgagctcgcgcaggcgggcgacatcgcgtgcctcgcgctgcaggccgcgcgcacgggcggcccggagatggcgttcggcgacgtcgagctggcgtcgcgctatcgcgcggtgtcgaccgaggtgccggatctcgcggtcgggctcgacgcgcccggcacgccgcggcgcctgacgatcgagacgggccagctcgtcacgcgcctgtgctggaagtcgcagctgcgctcggacgaggtcgcgctgccgatcgcgcgcgtggcggggcgcaacgcgagccgcacggtgtcgctggatccgcgcttcattccgccgctgctcgacacgcgcgcgcacctggtgctgcgctcgctgatcgacgagctgcagagcacgctgcgcgtgcggctcgcgagcacgtccgcgcagcgcgtgctgtcgacgggcgggggcgtggccgatctgatcgagctgctgctgcgccaggcgatcgccgagtaccggatgcgcttggcgaacctcgacgcgttcgatccgctgccgccggcgatgctgtatcacgagctggtcggcctgctcgggcggctgagcgtgctgccgggcgtcgacgaggaactggccgaccgcgagctcggctacgaccacgacgatctgcagacgagcttcgagccgctcgcgatgatgctgcgccaggcgctcgcgcgcgtgatcgagacgccggtgctgccgctgcgcttcgaggatcgcggcgatcaggtgcacatctgcatcgtcgacaagcagtggaacctgaagaaactgatttttgcgttttcggccgcgatgccggcggagaagctgcggcaactgttgccgcagcagacgaagctgggcgccgtcgagcagatccagaagctcgtggacctgcaactgccgggcgcgcggctgaacgcgctgcccaatcccccgcgccagattccctactacgcccaaagcacgtacttcgaagtggaatcgaccgatccgttctggaagcagaccctcgccggctcggcgatggcgctgcgcatcgtcggcgatttccccgatcttcgcttcgaagcctgggggctgagagacggcaaggtggcgtga

SEQ ID NO: 996 - DNA, 1860 bp, Burkholderia pseudomallei
atgcatagcccaccgtttctttcatcgcccaagcgcgcgctgccgatcgcgctcgcgctcagcctcgccggttgctcgatggagccggcctaccagcggcccgatgcgccgatgccgtccgcgtatccgaacggccccgcctacgcgacgccgggcgcgccgcgcgcgaacccgggcgagccggcggcggccgagctcggctggcggaatttcctcgccgacgcgcagttgcagcagctcgtcgcgctcgcgctcgcgaacaaccgcgacctgcgcgtcgcgacgctcgacatcgacgaagcgcgcgcgctgtaccgcatccagcgcgccgcgcagtttcccgcaatcgatgcgagcgtcggactcacgagccagcgcatgagccccgcgctgcgcgcgccggggcagtccgcggcgatcaacagctatgacgcgagcgtcggcctcacccatttcgagatcgacctgttcggccgcgtgcgcagcctgagccacgccgcgcaggagcaatacctcgcgaccgaggaggcgcggcgcagcgtccacatcagcctcgtcgccgaagtcgcgaacacctacctcacgctgctcgccgatcgcgcgctgctcgcgctcgcgcaggacacgctcaggagccagcaggacgccgccgacatgatccaccgcggcaagcaggcgggcgcgatggcgcagctcgacgagcatcgcgcggacacgcaggtgcagaccgcacgcgtcgccgccgagcaatacacgcggcagatcgcgcaggacgagaacgcgcttgccgtgctgatcggcgggccgctgccggccggcgtgtcgcgcgcggcgccgctcgacgatcgcgcgctgctcgcggagttcccggcgggcctgccgtcgacgctgctcgagcgccgccccgacatcatggccgccgagcatcggctcatcgccgcgaacgcgaatatcggcgcggcgcgcgcggcgttcttcccgaggatcacgttgacgggcgcgctcggcgtggcgagcgcgagcctcgcggggctgttctccggcggcgtcgcgtggctgttcgtgccgcagctcacgctgccgatcttcaacgcgggcagcaatcaggcgaatctcgatctcgcgacggtgcgccgcgacatcaacgtggccggctacgagcacacgatccaggacgcgttccgcgaggtcgccgacaacctggccgcacgcgcgacctacgagcgggaagtgaaagcgcaggaggcgatgatccgcgacctggccgagacgaagcggctggccgacatgcgttttcgcaacggcgtcgacgactacttcggcgtgttcgatgcgcaacgccagctgttcgccgcgcagcaactgctcgtcacctacaagcttgccgggctgacgagccgcgtgacgctatacaaggcgctcggcggcggctgggtcgaatcggcgggcgcggcggccgcgcaaccgcggacggggcaggccgcgccgatggctcgaccggcagccactccaccccagacgacgcgacccgcgccggttgctcgatcgcagacggttccaccgcgaacggttcagcccccgatcgcccaaccggcaaccgcgcaaccgcaaacggcgcaagccgcgccggttgctcagtcgcagacgattccactgcgaacggtccagccgcctatcgcccaatcgtcaacctctcaaccgcaaacggcgcaagccgcgccgatcactcaagcgcggacgacaccactccgaacggctcagccgcccgccgctcgacaacaggcgccgcaatccgctccggcggctcaaccggaggcagctccaccgcaaacggcccaaccgccgatttttcagccgtaa

SEQ ID NO: 997 - DNA, 1647 bp, Burkholderia pseudomallei
atgcaacgctgtctcgcccaccccgcccgcctcctcgctgcgacgctgctgtgcgtcgcgctcgccgcctgcggcgccgacgacacgaacgacagcgccgcgccgccgctcgcccggccgaacccgacgcccgacgcccccgcgccgacacccgccgccgcgcccacctactaccagacgaaaacgccttatcggccgcagcaggatgcttcgcgctacgaagcaccgcccgcgggctacgcgcccgtctataccgaaatgctcgcgcgccacggctcgcgcgggctgtccggcttcaagtacgacggcgcgatctacgacatgctgcaaaaggcggacgccgaaggcgcgctcacgccgctcggccggcaactgaaggccgacacgttcgcgatgatgaaggcgaacgcgctgctcggctacggcgtcgcgggcatctcgacgcccggctacggcaatctcacgcaggcgggcattcgcgaacatcagcagctcgccgcgcggctgctgcagcggctgccggcactgttcgacacggtcgcgggcacgacgggcggcgcggcgcgcaagatcgtcgtcgtgcattccgggcaggatcgcgcggtcgacagctcagcctacttctcgggcgcgctcgtcgccgcgcgccccgcgctcgcgccggcgatcacgtcgccgagcgcgatcgccggctatccgcaaggcgcgcccgtcgcgcaggcggtgggcgccaaccgcttcctgctgtacttccatgcgctgaagccttcggtcgacctcgtcgtgtcgacagacgatccgtattacgcgacctatcgcgacagcctcgcgtaccaggcctacggcggcagcgccgccgtcaccgcgaagctcgatgcgatcatgcgggcgccgcgaacgtcgcaggtcgcgcgaacggtgctcgccgcgctcgtgacgccgggtttcgcggcgaagctcggcacggcgggctacacattctcgaacacgggcacgtacacgttcgcgtcggcggacgcgaagttcgcccatacgctcaagggcgacggcaagaccacgatcaagtccgccgccgatgccgcgaacgtgctgtacaacctgctgcaggtcgcgcccgcgatgacggccgagacgggcggcgtcacgatggagcgctacatcgccgcgccgcaggccgagtatctcgcgtatcttcaggacgccgaggatttctacgaaaaaggcccgggtatcgccgagacgaaccccatcacctaccggatggcgcaggcgctcgtcgacgatttcttcgccgagatcgacgcgatcgcgcgcggcgatctgaccaatgcggcgaagctgcgcttcacgcatgccgaagtggtgattccgttcgcatcgatcctgaagctgaaagacgtgttcgcgcccgtgccgcaagcgcagacgtacacgtacgcgaacaatccgtggcgcggcgagacggtggcgccgatggccgcgaacctgcaatgggacgtctaccgcaacggcgcgcggctcatcgtgaagatgctgtacaacgagcgcgagaccgatttccagcccgcgtgcgacggcgcgcgcatcgcgcccggcagccgcttctacgactacgcgggcctcagacgctgctacggctatagctga

SEQ ID NO: 998 - DNA, 1557 bp, Burkholderia pseudomallei
atgaatgcctttttttcccgcttctcgattcgcacccggatcttctcgacgctcgggctcgttgccgcgctgctgacgatcaccggcgtgatcggcttcttcagcatgcagaactcgaacgccgcgctcgacgacgcgtacacgcggcaactcgcggcgaagacggcgctcgcgtcggcgagcctcaatctcgcgatcacgcgcacgacgctcgaccgcgtgatcctgcatccggaggtacccgacgcggcgaacacgatcgcgaaggcggagcagtatctggccgcgtcggagcgcggctggcgcgactatgaggcgctgccgcgcggcgacgacgaaaagacgctcgcggctcaggcgaacgccgcgcgccgcgcactcgccgacgaggcgctcaagccgatgatcgacgcgctgaaggccggccggcacgacgaagccgatcgcctgatgatgacggtcgcgccgccgctgtcggtcgcgtggacgaaggcgacgaacgcgctcgacgacgcgcgcgccgcgtatggcaaggccgcgtatgacgacgccgagcaaatgtacggctggctgcggctcgtcctcggcgggctgatcgtgttcggcctggccgcgtgcctcggctgcgcgatcggcctgcacttcgcgatcacgcagccgctcgtgcgcatcctcgggcacctgcgccgcctgtcggacggcgatctgacgggcgagctgcgctggacgtcgcacgacgaaatggccgagctcgtcagcggcctcacgacgatgcagcgcagcctgtcggagaccgtgcgcaaggtgacggacggctccgaatcgatcgcgaccgcgacgcgccagatcgcggccggcaacaccgatctgtcgcagcgcaccgaggagcaggcggccgcgctgcagcagacggcggcgagcatggagcaattgaccgcgacggtgaagcagaacgcggacaacgcacgcgaggcgcagaactgcgcggacaacgcgaccgacatcgcgacgaagggcgcgacggtcgtcggcgaggtggtcggcacgatggccgagatcgaccagagctcgcagaaggtggccgacatcatcggcacgatcgaggggatcgcgttccagaccaacatcctcgcgctgaacgcggccgtcgaggcggcgcgcgcgggcgagcagggccgcggcttcgcggtggtcgcgggcgaggtgcgcacgctcgcgcagcgctccgcgtcggcggccaaggagatcaaggcgctgatcggcgaatcggtcgagcgggtcgcgacgggctcgcggctcgtcggctcggcgggcgacacgatgcaggagatccagcgcgcgatcgcgcgcgtgacgggcatcatgaccgagatctcggccgcgtcgaacgagcagcgcgacggcatcgagcaggtgaaccgcgccgtctcgcagatggatcaggtgtcgcagcagaacgcggcgctcgtcgagcaggcggcggcggccgccgcgtcgctcgaggagcaggcggacgggctgcgccgcacggtcggcgcgttccgcgtcgtcgcctga

SEQ ID NO: 999 - DNA, 987 bp, Burkholderia pseudomallei
ttgttggagcacggcgtcatgaaaatcccgggtattaacaacgtcggaaaaactggacaggccggcggagaaaccgagcgtataccatcgaccgaacctttggggtccagcgccgcgaccagtcccgccggtccacttggtgggctgccagcacgttcgtcgagcatctcgaacactaaccgaactggcgaaaatcctatgataacgccgatcatttcatcgaacctcgggttgaagcatagagttaccttgcgcaaagctacgctagccagcctaatgcagtccctgagcggggaaagcagtaaccgcgtaatgtggaacgaccgatacgacacgctgcttattgcgcgcgacccgagagaaataaaaaacgccattgagaaaagcgtcaccgactttggtgggttggaaaactataaggaacttacggggggcgcagatccatttgctctgatgacgcccgtgtgcggactttcggccaacaacatcttcaaactcatgacagagaaggacgttccgatcgatccaacgtctattgaatacctggagaatacatcattcgccgaacacgtgaatacgcttgattcgcataaaaattacgtggtaatagtcaatgacggtcgacttgggcataaattcttgatcgacttgcccgccctgacccaggggcctcgcacggcatatatcattcagtctgatctcggcggtggagcactgccggcagtcagggtagaggactggataagccgccgcggcagtgacccagtgtcgctcgacgaactaaatcagctattgtcgaaggatttttcaaaaatgcccgacgatgtgcagacgcgtttgctagcttccattctgcaaatcgacaaggatccacataaagtcgatatcaaaaaattgcacctcgatgggaaactgagattcgcatcgcacgaatacgattttcgtcaatttcaacggaatgcacaatacgtcgccggccttggctag

SEQ ID NO: 1000 - DNA, 1767 bp, Burkholderia pseudomallei
atgaaagcgaaagcgctgttgtgcgcggcatggtgcgtcgcgatatttggcaccatcgggatcggcgccgcgaacgcgatgcccgtgcgctggaggagtacggtcgtgcatgtcgtgctggaaggcaaggatctaaaggacgtactgagggattttgccgcgagtcaaggcgtcgcgacatcgattgccggcaatgttcaaggtaccgtcacgggccgattcgatctgtcgccccagcgctttctcgatacgctcgccgcgactttcggattcgtgtggttctacgatggcaatatcttgtcgatcacaaatgcaaacgatatgacgcggcaagtcttgccgctcgatcacgcttcgatcggcgaattgcgttccgcgttgcgccagatcggcatggacgacaagcgctttccgatcttctacgacgaggtgtccggcaccgtgctcgtcagcggtcccgcccagtatgtccagatcgtgaccgatatcgcgcagcggctcgacacgctgtcgggccgccgaaacggctcgacaatccgcatcttcaagttgaagcacgcgtgggcggccgatcgcaacgtgcagatcgacggaaacacggtgaccatgcccgggatcgcgaccgtgctggcgaacctgtaccgcgtgcgaggaagggcgggaaccggtcagtcgagtgcggcacccggcgtgcagcgggtgcagccgatgggcgacgtttccggcagtgcgtatggcgggaaccggctgatgcctccattgccgccgagcatgatggggggaggccgcggcgacgcattcgccaagggggcgtcgatcgacggcgaaagcgggggagccgcgagcgccgcgcctggcggagcgccccggacggaggaggtgtccgcggagcgcgacgagttgccgatcatccagcccgatccgatgacgaactcggtgttgatccgcgatttgcccgatcgccttgcacagtatgcgccgctcatccagcaactcgacatacggcccaggcttatcgaaatccaggcgcacatcatggagatcgacgacgacttgcttcgggagatcggcgtcgactggcgcgcgcataacagccacggcgatattcagacaggcacgggcaatacggcgcaaaacgattattcgggcggccagatcaatccgttcttcggtacgacgacgcttgcgggcaacgcggttgtcaacgcggcgcccgccggcgtgtcggtcacggcggtcgtcggggacgcggctcgatatttgatggcgcgggtgagcgcgctgcagtcgacctcgaaggtgaagatcgatgcatcgccacttgtcgcgacgctcgacaattcggaggccgtaatggataacacgacgcgctttttcgtcaaggtatcgggttacgcgtcggcggaactctacagcgtgtcgacgggtgtttcgctgcgcgttctgccgatgatcgtgcaagacggtagcgagacccggatcaagatgaatgttcacgtgacggacgggcaactgacaggcgaccaggtcgataacctgccggtcatcacgagcagcgaaatcaatacgcaagcgttcgtcggtcaggggcagagcctgctgatcgccggctacagtacggacaagcgcgcgaacggtgtggcgggcgtgccttggctgtcgaagatcccattgctcggtgcgctgtttcgataccacagcgattcgcagaaccacatggagcgcgtattcctgttgtcgccgcgaattatcgatccgggcacgtga

SEQ ID NO: 1001 - DNA, 1425 bp, Burkholderia pseudomallei
atgaacgctcgacgtccggcgttcggcctgattgcgtcgcacgcgtcacgccgccgggccgtcgaatccgttcgcgcccactttccgctcatgttcaccctctgtcttgcgatgaaacacacttcgaaccactccgacccttccggtgcgccgtcgtcagcgcgacgcgccgcatccgattcgtcccgcctcgtccgcggcatgcgctcgccccaacgcggcggcgcggcactggcgctggccgtcgcctcgctcgccggatgcgggggcggcgattcgggcgaacccgctccacgcgaattcgcgcccccgacagtgcaactcgcctacccgacgcaaccgaactcgcccgtcgcaccagcgcccaccgcgcacgtatcaagcggacacacgcctccggccacggcgcccgccgcgatgcccaccgcttcacccaccgcgacgcctaccgcttcacccaccgcgacggctgccgcttcgccctccgcgccatccactgcgacgcccaacgccccgcccgccgctccgccggccgtcgtcgccacccgcgtcccgccgacgcacgcggcgttgcgccgcccgacgatcgaactcgaattcgatcgcgcgatcgagccgggttcagtcccacacatcgcgctgcgcgccgacgatggcacgagcgtcgccgtcggcccgttgtcgtggctgagcgatcgccggatcgcgttcgcgccgcgcaaaccgctcaagtcgaacagccgctacgaaatcatggtgcccgccggcatcaggagcaccacgggcgaacggtcggctcatccgctaacgagcagcttcgataccgcgcccgtcacgccgccgcgcggcctgcccaatctcgacggcgcctcgtgcttcatcaacacggcgctgcaattggcggttcactcgtcggcgctcgacgacattctgtcgaacgaagccgtcccgcccgccgtccgcacgctgctcgaagactacgacgccgcatcggctgacgcactcgacgcgcagttggccgccgcggtcgccgcgctgcgcgccacgccggaggtcccggacagcgggccgggacaaacgctggaagtgatgcaagcgttgcggatgccgttatatgacacgagcagcgcgaacaacgcaacgaacaacgccgacgccatacgtcatgcgccgcccaacaccaaggcgttctttctgaactcctatccaccgctttcctacgcggatctgccgaaccacgaccggctcgtcgcgttcgactacagcacgggcggtcactatgtcgcttatgtgaagcgggatggaatctggtatcgaatcgacgatgcccaggtcagcgccgtcaacgaacaggacttgcttgccctgccggcgttcaaccccgctaacggcagcgtgtcgatcgaaatcgcgatctatcgatga

SEQ ID NO: 1002 - DNA, 1410 bp, Burkholderia pseudomallei
ttgagtaccgacgatctcgtcaaagcgccacctgagcatcgcgccaagatggctggcgtgaggctaggcattggttcggcgggagatcggcttaacttccttgaacgcaatggcgtgatgccggcagaagacaaggtactgacagccgctcgctatgcccacaacgttaaaatcgaccataagaacgcttcaaacctcgaattccagttaaatcgcatgagaatcggtgaagtttccttgccgaaacaggcaaagcctgattccatggaaatacgcaatgcgttagatgtaatcccgttggcgcttcccgataggaacgaaaagcatacgataccgaccgataaatacttgatgaatcggctgtcgtccggcgccgtggaacaagcgaggcatcacggctgtgaatttttctgtggcagcggccgagatgagatgctcaatcactacgctcatcgtgggttcgatcgtgccatcagcatttccagcaacacctcgacaaaattcgatttgctttctaactcttcgaatggtaaatcgctgctcgttctcagtggcatgagcagcaccacgcgaatcaagcatcaactgttacagttgcattttgccgatgtcgatttgaatcgagtcaaactcgtaggcgacatcaatttgctaaaggcaaaaagcggagacgatctccgtaaagagttgtcgcagcttccaccgatcccaagcaagacgcttttcatcggcgcccgttggcaaatcatggaatctctcgggaaacaacttttccatgtcggcgattcggcgaaagaaggtacggggtatggcaagctcggcgtgaaagaacacaaagttgccgattttgtattcgataccgcaacactgaatctcgatggacgtcagcatctcgttgccgcgctgcgtatgccaaatggcgatttggcttacgatgcaatgaaaggattccttgatcacgggttcaatcaggtcatcatgtgcggcgccggaggtcgattggcaggcgatgcgcaggtcggcgactacatgctgctggagcgcagtcaatatggagatcaaagcatttcactcgcacgggaatgcatccacgtgccgggcgccaaactcttcgagaatgctaaaccaacgagcaatgtcacggtcgattcgccattgcaagaaacacagcggtggctcgacgagaatcaggagacaggcaatgtcgatgttgaaaccgcgcatatccttcgcgcactcacggaagctggacctgacgtcaaagtcctccccggattgttcgtatcggatgtggtcggcgaacatccgctagaggggaagattagcagcgacgatgcgtatcggcgattgccggaatttgtcaccgcctcgctgggaatgatccgggaacaggacaccccactcgcatga

SEQ ID NO: 1003 - DNA, 1260 bp, Burkholderia pseudomallei
atgtcaatcggtgtgcaaagcagcggcatcaacatcagccacgcggagctgtcccggctcgtcgatgcgggcaagtccgagcagggcgacaaggcggttcgcgacgacgggcgcgcgctcgcgcgcgcggacgcggcgctcgcggccgtcgtcggcgagcgcgtggcggcgcggcgcgatgcggttgcgggctcgggcgcgcagcgcgtcgagctcgcccggccgaaacccgacgcgcagacgcgcgcgacggaccggcggacggtctccgggctggagcgcgagcacaagcggctcgccgcgagccagacgccgcgcgtgaccggcatgcacgatgcgctcgtgcagcgccacgtgtcgctcgacggcgcgaaggcggcgcacggcgaaggcgtgaagcgcgccgcgggcgatgcgccgcgcgcggcggcggacgcgccgcagcgcttcgcgttcgccgacgacaaggcgttcgacgcgatgctcgcgctcggcgccgcgatgcagaagaacgtgcagtcggatctcgcgatgcagggcaagctcacgatgctcgcgcacgacgcgatgatgagcgcggccgcgcaggatcgcagcatcggcgccgcgcagatgacggccgcgatcgcgggcggcgcgctgcaggcgacgacctcgctcggcggcgcgatgcagcagatgaagagcttgagcacgaagtcgatgtcgatcgaaaaggagctgaagccgcaggcggagctcaagcagttccacgcggagcaggcgctcgagctgcgcggcatcaacaagccggtgttgtcgaacgacgaagtgtcgcacgtgaagatcaagcgcgacaccggggagaccgtgcgccacgagatcgaccacggcggcgagcggatgagcgacgagcacgcgagcgtgctcgcgcaggaagcgcccgcccgtcagcaccggatcgacatgcacggcatgcgtcacgaggagaacctcgtgaaggcgggccgccagcagatgaagggcgatctgctccagtcgggcggccagatcggcaagaaccagatcgacggcgcgtcggcgcagcagcagggcgcggaccgcgccgagcagaaagaggacgagaacgcgcagcagaccgcgatggccgcggcgagcacgcgcgacgaagccgcgcatcgcagccgcgaagccgcgcagaaggcgatcgacgcggcgaagagccaggtggcgaacgacaacgcggtggccgcgcaggtggccggcaatctgcggacctga

SEQ ID NO: 1004 - DNA, 1863 bp, Burkholderia pseudomallei
atgtcatcgggagtgcagggcggaccggccgccaacgcgaacgcttaccagacccatccgctgcgcgacgcggcgagcgcgctcggcacgctgtcgccgcaggcgtacgtcgacgtggtgtcggccgcgcagcgcaattttctcgagcggatgtcgcagctcgcctccgagcagtgcgacgcgcagccggcggcgcacgacgcgcggctcgacgacaggccggcgctgcgcgcgccgcaggagcgcgatgcgccgccgttgggcgcgtcggacacgggcagccgcgcgagcggcgcggcgaagctgaccgaattgctcggcgtgctgatgagcgtcatcagcgcgagcagtctcgacgagctcaagcagcgctcggacatctggaaccagatgtcgaaggccgcgcaggacaacctgagccggctgtccgacgcgttccagcgcgcgaccgacgaagcgaaggcggcggccgacgcggccgagcaggccgccgccgcggcgaagcaggcgggcgccgacgcgaaggccgcggatgcggccgtcgacgccgcgcagaagcggtacgacgacgcggtgaagcagggcctgcccgacgatcggttgcagagcctgaaggcggcgctcgagcaggccaggcagcaggcgggcgacgcgcacggccgggcggacgcgttgcaggcggacgcgacgaagaagctcgatgcggcgagcgcgctcgcgacgcaggcgcgcgcatgcgagcagcaggtcgacgacgcggtgaaccaggccacgcagcagtacggcgcgagtgcctcgttgcgcacgccgcagtcgccgaggctgagcggcgcggccgagctcacggccgtgctcggcaagctgcaggagctgatctcgtcgggcaacgtgaaggagctcgaatcgaagcagaagctcttcaccgagatgcaggcgaagcgcgaggccgaactgcaaaagaagtccgacgagtatcaggcccaggtgaagaaggccgaggagatgcagaagacgatgggctgcatcggcaagatcgtcggctgggtgatcaccgcggtcagcttcgcggcggccgcgttcacgggcggcgcgagcctcgcgctcgcggccgtggggctcgcgctcgcggtcggcgacgagatcagccgcgcgacgacgggcgtgtcgttcatggacaagctgatgcagcccgtgatggacgcgatcctcaagccgctgatggagatgatctcgtcgctcatcacgaaggcgctcgtcgcgtgcggcgtcgatcagcagaaggccgagctcgccggcgcgatcctcggcgcggtcgtgacgggcgtcgcgctcgtcgcggccgcgttcgtcggcgcatcggcggtgaaggcggtcgcctcgaaggtgatcgacgcgatggccggccaactgacgaagctgatggattcggcgatcggcaagatgctcgtgcaactgatcgagaagttctccgagaagtcggggctgcaggcgctcggctcgcgcaccgcgaccgcgatgacgcggatgcgccgcgcgatcggcgtcgaggcgaaggaagacgggatgctgctcgcgaaccggttcgagaaggcgggcaccgtgatgaacgtcggcaaccaggtgtcgcaggcggcgggcggcatcgtcgtcggcgtcgagcgcgcgaaggcgatgggcctgctcgccgacgtcaaggaagcgatgtacgacatcaagctgctcggcgatctgctcaagcaggcggtcgatgcgttcgccgagcacaaccgcgtgctcgcgcagctgatgcagcagatgtcggacgcgggcgagatgcagacgtcgacgggcaagctgatcctgcgtaacgcccgcgcagtgtaa

SEQ ID NO: 1005 - DNA, 1107 bp, Burkholderia pseudomallei
atgagctcgatcatcggcggcgcgtcggccgcgcggcgcggcttttcgatcgacggcacggggagcgcggcgaaccggctcgacgcggagccgtcgctcgacgacgcgccgcagacgggggcggcgggcgcggccgacgtgcaggcgcaactcgccggcgtcgacgaggaggccgcgaacgccgccgcgcaattcggccggttccgcgcgtcggagcgcaaggggcggcgcagcgacgagctcgaacggattctcgacacggacgccgacgagaagctcgacgagctcgccgcgctgctcggcggccgcgcggacctcgcgacgctgctgcgcgacgcgcgcgagcgctttcgcgacgagagcgatctgttgctcgcgctgcgcgagctgcgccggcggcgccggctcgacggcgaatccgtcgacgcgctcgagcgcgcgatcgacgaactgctcgcgggcgacggcgccaagcggatcaaggcgggcatcaacgcggcgctcaaggcgaaggtgttcggcgcgcggatgcaactcgatgcgcgccggctgcgcgagctgtaccggcagttcctcgagttcgacggctcgcacctcgtcatctacgaagactggatcgagcagttcggtgcgagccgccgcaagcggattctcgactacgtgagcgccgcgctgtcgtacgacatgcagtcgcacgatccgagctgcgggtgcgcggccgagttcggcccgctgctcggcacgctgcatcgcgcgcgcatgctcgcgtcggccgacgagcagttcgtcggccggctgctcgacgacgcgctcgcgcgcgattgcgggctcaccgaggcgcgcgcgctcgcgacgatgctgggcggcctgcaacggccgttctcggtcgccgacgtgctgctgggcacgctcggcgatctgctcgagccgctcgcgcccgcccgtcgctcgcagttgttgcagctcgcgctgcgcgcgttcgcgggcgtgccgatcgcgctctacggcgacgccgacgcgcgccgcgcggcgctcggcgcgctcgaggagctgatcggcgcgacgtatgcgcgcgagcggcggcaggcgcgcccgcgcgccgactga

SEQ ID NO: 1006 - DNA, 1401 bp, Burkholderia pseudomallei
atgaaaaaactgaaatacgcggcagcgctgctgaccgcggtcgcgatgagcccgtcgtggtcgcaagcctcgaccctcgtcgcgcaatcgcacgtggacggcgtgagccgcgccgagccggcgaaaatcggcgagcagctcgccgcgcgccgcgcgtcgctacccactctgccgcgcccgctgcccacgctgtccgccggcgcgatccgccaagccggcctgcgcgcgccgctcgcgaagcgccaggcgacgctcgccgcgccggccgccgcgaccgtcgcgccgcccgtcgcgaactgcaccgacgtgacgatcggcgccgcgtacaacgcggccaccgcgcccgccggccaggccgactgcttccagttcgtcgcgccgagcgcgacgaagatcgtcgcatacgtcgtgaacctgcccgcgaacgaacagcacgacgcgcatctggtgcaggtcaacgaagacggctcgtggacggtgctcgacagccaggccgacctgtcgccaaacaagatcgtcgaggcggtgccgaacggcccggtgcgcctgctgctgctcgtcagcgcgcagcagggcgcgggcaacgcgccgttccagttccaggtgctcggcacgacgggctacgacagctacgagccgaacgattcgatcctgcatccgacgaagctcacgggcaaccagctgatcagcgcgaacctcgatacggtcgcggatttcgactactacgcggtgcaggtgccgtcgacgcagacggcgaactacgtgacgttcaagggcgcgggcacgcaaacggccgagctcgagaccgcgccgaacacgtgggcgacgctcgcgtcgggcacgtcgtacaacatcacgtcgcccgcgggcgcgacgctgatgttccgcgtctacgacaagggcacgaccgcgcccgccgcgcaggcatacacgctgcgcatatcggacggcgcgggcaccgcgggcttctatcgcttcctcgacgaagagaacatcacgcacctcgtgcgcggcaacgagaacgtcgcgcgggtcgtgtcggcgggcacgattgcgtgggactcgacgggcaacgtgcgcctgccgccgggcgagcgcatctggctgcgcgcgtacgatagcgcgggcccgaacggccccaacacgctgctgtcggaaacctcgggctacaccgacgcgaacggcaacctgctcgtcaatctgaatgtcggcgtgtgccagggcggcggaacgatgacgggcgacttcaatacgatgtcggtgccttcggatcgctggcggatcacctacaacccgtatgcgttcgtggtcgcgtatctcgacaacgcgcaaatccgggcgcagacatcgatcaagcacttcacgcacatctgcaccgagcagtacctcggccgcaagtaa

SEQ ID NO: 1007 - DNA, 480 bp, Burkholderia pseudomallei
atgtacgcgttagccgccgcactggccttcgcctcgctcgccgccgtctacgcggcgctgcagggcccggctgccgttcccgcgctgcaaccggcgcgcgccgcgcaggcgctcgccgacaatctcgccgtctatcgccaggcggcgctcgactacgcgcgcgcgcatccgggcacgcgcggcgcggtgccgaacgcgcggctcgcgtttcccgcgtggtatccgggcgcggacccgctctggcgcaactacgtcgagaacggcaccgtcgtcgcgtatgcggcgtccgcgccgcccgtgaacatcgcgggcgaggtcgcgacgctcgccgaaggctcgctgctcgcgggcgtcgcgtatcgcggcgcggtcgtgcgccccggtcgggcggatccgaacgcgcccgcgagcggcgtgccgctgcccgcggggctcgcgatcgccgacggcctgccggtctggatggggcaggcgtactga

SEQ ID NO: 1008 - DNA, 855 bp, Burkholderia pseudomallei
gtgatcatgaaaccactccgtctcccgatttccgccgccggcgcgcgccgcgccgcccgcctcgccgcgctcgtcgcgtgcgtggcgctcttcgccggctgccggcaggagctgtacggcggcctcgccgagcgcgactgcaacgagatgatggccgcgctgctgcaaaacggcgtcgacgcgcagaagaagacgcccgacggcggcaagacatggacgctcgccgtcgacgacaagcagatcgtcaaggcgatggaagtgctgcgcgcgcgcgggctgcccgcgacgcgctacgacgatctcggcgcgctgttcaagaaggacggcctcgtgtcgacgccgaccgaggagcgcgtgcgcttcatctacggcgtgtcgcaggagctgtcggacacgctgtcgaaaatcgacggcgtcgtcgtcgcgcgcgtgcacatcgtgctgccgaacaacgatccgctcgcgcaggtcgcgaagccctcgtcggcctcggtgttcatcaagtaccggccgaacgcgaatctcgcgacgctcacgccgcagatcaagaacctcgtcgttcatagcgtcgaagggctgacgtacgacgaagtgagcgtcacctccgtcgcggccgatccggtcgatctcgtgtcggccgcgcagcccgccgcgcagaactcccgcggcgcgacgctcgtcggcgtgctgatcgcgctcgccgtgggcggcgcgctcgcggccgcgggcggcgcgctgtggtggcgcgcgcgcaagcgcggcggcggcgcgggcgcgcacggaatcgccgcgcggccgcgcggcggcgcccgcgacgcgaaggccgccgcgccccggcaggccggcgcgcaatga

SEQ ID NO: 1009 - DNA, 984 bp, Burkholderia pseudomallei
atggctaagcccgcaaagcgcgttgccgtcaccggcgccgcaggtcagatcgcttactcgctgctgtttcgcatcgcgaacggcgacctgctcggcaaggatcagccggtcatcctgcaactgctcgacctcccgcaagcccaggccgccgtcaaaggcgtcgtgatggaactggacgattgcgcgttcccgctgctcgcgggcgtcgtgatcaccgacgacccgaaggtcgcgttcaaggacgccgacgtcgcgctgctggtgggcgcgcgtccgcgctcgaagggcatggagcgcaaggatctgctgtcggcgaacgccgagatcttcacggtccagggcgcggcgctgaacgaagtcgcgagccgcgacgtgaaggtgctggtcgtcggcaacccggcgaacacgaacgcgtacatcgcgatgaagtcggcgccggatctgccgaagaagaacttcacggcgatgctgcgcctcgaccacaaccgcgcgctgtcgcagctcgccgcgaagtcgggcaagccggtcgcgtcgatcgagaagctcgccgtgtggggcaaccactcgccgacgatgtaccccgacttccgcttcgcgaccgccgagggcgaatcgctgctgaagctgatcaacgacgacgtgtggaaccgcgacacgttcatcccgaccgtcggcaagcgcggcgcggcgatcatcgaagcgcgcggcctgtcgtcggcggcgtcggcggccaacgcggcgatcgaccacgtgcgcgactgggtgctcggcacgaacggcaagtgggtcacgatgggcatcccgtcggacggctcgtacggcatccccgaggacatcatctacggcgtgccggtgatttgcgaaaacggcgagtacaagcgcgtcgagggcctggaaatcgacgcgttctcgcgcgagaagatggacggcacgctcgccgagctgctcgaggagcgcgacggcgtcgcccatctgctgaagtaa

SEQ ID NO: 1010 - DNA, 2250 bp, Burkholderia pseudomallei
atgacatccacattcctgcgtcacgcgcccaccgcgcgtggagaccacgcgcgccgccggcggcgcgcgatcacgcttaccgttcccgcgctcgccgcgggcgcctttcacctcgcgccggccgtcgcgcagacgagcgaggccgtgcacggccacggcacgctcggcgcgtccggcgtagcgagccgcgccgacaccgacgcggcgagcgccaaatcggacggcgcggttcgcgaagcggcgagcgccgcggcgagccgcacgacgaccggcgccgcgccggacgccacgacgctgccgacgatcgaaatcgtcgcggcgcccgaatcgacgccgctcgtcgtcgtcaccgatccgaagacgccgcgccagccgctgcccgcgagcgacggcgccgattatctgaagacgattcccggcttcgcgtcgatccgcagcggcggcacgaacggcgacccggtgctgcgcgggatgttcggctcgcggctgaacattctcgcgaacggcatgccgacgctcggtgcgtgtcccggccggatggacgcgccgacgtcgtacatcgcgcccgagagctacgacaaggtgacgctcgtcaaggggccgcagaccgtgctgtacgggccgggcgcatcggcgggcacggtgctgttcgagcgcgtgacgccgcgcttcaagacgccgggcatgcgctttgacggcagcgtcgtcggcggctcgttcgggcgcaacgatcagaacgtcgacgtgacggccggcacgcccgacttctacgggcgcgtgagcgcgaaccatgcgcactcgcaggactacgaggacggcaacggccgcacggtgccgtcgcaatgggacaagtggaacgcggacgcggcgctcggctggacgcccgacgacaacacgcggctcgagctgacggcgggcacgggcgacggctacgcgcgctatgcgggccgcggaatggacggcgcgcatttccggcgcgagacgttcggtctgaagttcgacaagaagcacatcggcgacgtgctcgatcgcatcgatgcgcaggtcttctacaacgaagccgatcacgtgatggacaactacacgttgcggatgcccgatccgacgagcagcatgccgatgcgcatggcctccgaagtgcgccgccgcacgctcggcgcgcgcgtcgcggcgacgctgcgcttgaccgacgcgttcaagctcgtgacgggcgtcgatgcgcagtcgaaccgcctcgactcgcgctcggcgatggggatgcagaactacggcgacaagccgtggaatccgcaggcgaacatgtggaacgcgggcgcgttcggcgagctgacctggtatgcgagcgatgcgtcgcgcgtgatcggcggcgcgcggatcgactatgcggccgcgcgcgacaagcgcgcgacgacgggcggcatgaagatgagcatgcgcaatccgacgttcgacgatcttcgctcgcgcgtgctgccgagcggcttcgtgcgctacgagcgtgatctcgcgtcgctgcccgtcacgtggtacgcgggcatcggccatgcgcagcgcttccctgattactgggagctgttctccgccaagcgcggcccgaacggttcgatcaacgcattctccgcgatcaagcccgagaagacgacgcagctcgacatcggcgcgcagtacaagagcgacaagctcgacgcctgggtgtccgcctatgcgggctacgtgcaggacttcatcctgttcgactatgcgacgggcccgatgggacagatcacgcaggcgacgaacgtcaacgcgcagatcatgggcggtgaggtgggcgcgtcgtggcgtccgctcgcgccgtggcgcttcgaagggtcgctcgcgtatgcgtgggggcgcaacgtgcaaagcggtgcgccgctgccgcagatgccgccgctcgaggcacgcttcggcgtcgagtacactcgcgggccgtggtcggcgggcgggctgtggcgggtcgttgcgccgcagcatcgctacgcgctgaacgagggcaacgtcgtcggcaaggactttggtccgagcgccggtttcggcgtgctgtcgctgcacgcgcagtacaacgtgagcaagacggtgcagatctcggtcggcgtcgacaacgtgctcgacaaggcttatgcggagcacctgaacctcgcgggcaacgccggtttcggctatccggcgaatctgcctgtcaccgaacccggccgtaccgcgtgggttcgtttgagcaccaagctctga

SEQ ID NO: 1011 - DNA, 1719 bp, Burkholderia pseudomallei
atgcaaaaactgttcaataaatcggccatcgcaatcggcatttccacccttctcgttctgtccggctgcggctcggtcgacggcccgtcgctgtcggccagcggcgtcaagcccgccaccgtcggcaatacggggacttcggggacgtccggcacttccggtacgtcgggtacttccggcacgtccggcacctccggtacgtcaggtacttccggcacgtccggcacctccggtacgtccggcacctccggtacgtctggcacgtccggtacgtctggcacctccggcacctccggcacgtcgggtacttccggtacgtctggcacctccggcacgtctggcacctccggtacgtccggcacctccggcacgtctggcacctccggtacgtccggcacctccggcacctccggcacgtctggcacgtccggtacgtctggcacctccggcacgtcgggtacttccggcacgtcgggcacctccggtacgtcgggtacttccggtacgtccggtacctctggcacgtcaggcacctccggtacgtcgggtacctccggcacgtcaggcacttccggtacgtcgggcacgtccggcaccgcctcctccccgctcggcaacatcctcgcgcaaaccggcaacctgatcaccgcgacgggcaccgtcgtctccgccaccggcaaccaaatctccggcacgtcggtgccgggcgtgaacggcgcgacgacgacgaacctcggcaacgccgtcagctcgctcggcaacggcgtccagacgctcggcaacggcacagccgccggcctcggcacgctcggcacgtcgacgaatccgctcggcccgacgctcacgtcgacctccggcgtcgtctcgaacgtcggcaacgcggtctcgtcgctcggcggcgtcgtgacgagcatcggcaccggcccgctcgcgccgctcgcgcccgtcacgtcgccgctcggcggcgcggtcggcacgctcggcagcaccgtcacgcaagtcggctccggcctgaacaacgtgctcacgagcgcccccgtccagcagctcgaaaccggcgtcagctcgatcatcaacccgatctcgaacgtcgtttccggcacgacgcagacgatcggcaccgccaccgggctcggcgcacccgtcaataatctgctgaccaccgtcggcaatgggctgaacgcggccggcgcgaaggtgtcgggctcgacgaacaaccaggtggtgcaggcggtcggcggcgtcgtcagccagctcggcaacacggtcacgagcgtcggcggtctgctgacgggcggcaccaccaacccgctcgcgccgatcaccggcatcgccggttcgctgagcggcacgctcggcgccaacgcgggcctgaacgcaggcgcgacgcaacccggcacgacgacgaacccgctcgcccccgtcaccggcctgctcggcggcctgtcgggttcggcgggcggcaacgcggcggccggcctcaccgccgtgctcgcgcccgtcacgaatgtcgtcggctcgctgaccgccggcgtgaacggcaccgtcgccgccccgtcgcccgccccgaccaccggctcgacgacgaccgcgcccgccacgggtgtggtcggcagcctgacgggcggcacgaccgcgagcggcacgtcgacgacgaacctgctcgcgcccgtgaccaacctgatcggcgggctgctcggcggcgtgtcgggcaagtag

SEQ ID NO: 1012 - DNA, 1503 bp, Burkholderia pseudomallei
atgtcaatattgattcgtactgcttcgttcaaggcgaccgtcctgtgtgccgcgctggccggcctcgtttcggccgcgcaagcggaaaccgcggccgcgccccaggtgccggggcccgccgacgcggtcaatcagttgatcgtcaagttgcgcgcggtgaagacgccgcccggtgcgacggccgcgaaggccgagcgcgcggacgttcaggccgtcatcgatcgcgtgctcgccgcgcgcaatgcgcgggcggcggggcgtgcgttcggcgcggccgccgcatccgcgcccggcaatccggacgaccccgccgcgggcattcgcatcaagcgcgacatgtcgggcggcgcgaccgtgctgtcgctgcagcgccacgtgtcgctcgcgcaggccgaggcgctcgcgcgcgacttcgcggcggacggcgcgatcgaatatgcggagcccgatgcgcggatgcatccgttcgtcgtgccgaacgatacgcgctattcggagcaatggggctacttcaatccgaccgccggcgcgaatctgccgaaggcttgggatcgcacgaccggctccgcgcgcgtcgtcgtcgccgtcatcgataccggctaccgtccgcatgcggatctcgccgcgaacctgctgccgggctacgacttcatctccgatatcccgagcgcgaacgacggcaatggccgcgacagcgacgcatcggatcccggcgactgggtgagcgcgcaggaagacggcgatccgagcggcccattctatggctgcggcgcgagcgacagctcatggcacggcacgcacgtcgcgggcacgatcggcgcggtgacgaacaacggcgtcggcgtggcgggcatctcgtgggtcggcaaggtgctgcccgtgcgcgtgctcggcaagtgcggcgggatgctgagcgacatcgccgacggcatgcgctgggcggcgggcctgccggtgccgggcgcgccgtcgaatccgaacccggcgaaggtgctgaacctgagcctcggcggatacggccgcacatgcagctcgacgtaccagaacgcgatcaacgaaatcacgtcgcgcggcgcgaacgtcgttgtcgccgcgggcaataacggcggctcggtgtcgacgactcagccggcgaattgccggggcgtgatcgcggtcggcgcgatcgacagccgcggcgtgcgcgcgagcttcagcaacaccggcgccgcggtgaagatctccgcgccgggcgtcggcattctgtcgacgctcaatgcgggcaagacctcgccgggcgcggacagctacgcgagctatagcggcacgagcatggcaacgccgcatgtcgcgggcacggtcgcgctgatgctcgccgtcaactcgacgctgtcgccttcgcagatcttgcagcggctgcaatcgagcgcgcggccgttctcgagcggatcgagctgctcgacgagcacgtgcggcgcagggctgctcgacgcaggcaacgcggtcgacgccgccgcgcagtga

SEQ ID NO: 1013 - DNA, 1665 bp, Burkholderia pseudomallei
ttgcgccgcgcgttgccattccgctaccactatcaatcgcacacgatgaaacacacgcatgccttcgcggccgtgctggccgcgctcgccctgacgatcgcgccatccgccccggccgtcaccgttgcctcgaatgtcacgctcgcggatcagcaggacctcacgcggcaggtgcccgcggaggtcgaatcgctcgaccccgcgcacatcgaatcgtggaccggcaacacgatcggcctggatctgttcgaggggctcgcgcgcatcgacgcgagcggggcggtggtgccgggcgtcgcgcaggcgtgggagcacaaggcgccggatacgtggatcttcaagctgcgccgcgacgcgaagtggagcaacgggcagcccgtgacggccgcggatttcgtatacgcgtggcagcgtctcgccgatccgaagacgggttcgaaatacacgatcctcgtcgagttcgtgaagaacgcctcggcgatcatcgcgggcaagcagccgcccggcgatctcggcattcgcgcgatcgatccgtacacgatcgaggtgaagaccgaggtgcccgtgtcgtatttccccgagctcaccgcgatggcgccgctcacccccgtgaacaaggacgcggtcgcgaagttcggcgacgcatggacgcgcccgaagaacatcgtgagcaacggcccttacacgctcgtcgactggcagccgaacaaccggatcgtgatggcgaagagcgacaagtactggaacgcgcgcaacgtcgtgatccgcaaggtgacgtacctgccgatcgagaacgacgagaccgcgctgcggatgtaccaggcgggccagatcgactacacgtattcgattcccgcgggcggcttcggccagatcagcaagcagttcggcaaggagctgcgcccggggctgcagctcgcgacgtattactactacctgaagaacagcgatccggcgctcaaggacaagcgcgtgcgcgaagcgctcgcgatggtgctcgaccgcgagatcctcacgtcgaagatcacgcaggcgggcgaagtgccgatgtacgggctgatgccgaagggcgtgaagggcgtgcagcggccgttcacgccggactgggcgtcgtggccgatggcgaggcgcgtcgactacgcgaagaacctgctgaagcaggcgggccatggcgacgcgaatccgctcacgttcacgctgacctacaacacgaacgacctgcacaagaaggtcgcgctgttcgcggcgtccgaatggcgcacgaagctcggcgtgacggcgaagctcgagaacgtcgagttcaaggtgctgatgaagcagcgccacgacggcaaggtgcagatcgcgcgcgacggctggttcgccgactacaacgacgcgatgacgttcttcgacctgatccgctgcggcagctcgcagaacacggtcggctactgcaacccgaaggtcgattcgctcgtcgccgaggcgaaccagaagctcgatgacggcgcgcgcgcggcgctgctcacgcaggcgcacgatctcgcgatgaacgactatccgatggtgccgctcttccagtattcggcggaccgcctcgtgaagtcgtacgtcggcggctacacgctgacgaactacatcgacatgcgcgcctcgcaggacatgtacctgatcaagcactga

SEQ ID NO: 1014 - DNA, 1692 bp, Burkholderia pseudomallei
ttgcggacgacgaaatctcccggcatctccgtgattcggcagcggctcgccgttgcgctgccgcttgcgttgacgctcaccctcgcgagctgcggcggtgacgatctgacgcccgccgcgcagcgctgggcgatgcccggcaccgaactgccgctcgggccgcagggcctcgcgcagagcgtgtcgacgcagacgctcgccgcaggcgtcgcctattaccagatcaagcgcggcgcggcgagcgcggccgatttctggaccgtcaacctcggcttctacgcgacgcaggccgcggcgcaggccgatgcggcgaatctcgcggcggccggcttcgcgacgcgcgtcgacgcgtcggcgggcaccgacctgcagggcaaggtgctcggctactggctgtcggccggccgctacgcgacgcaggccgaggcgacggcggccgccgcgcgcatcgcgcaggccacgcagaaccgctacaagccgggcacgcggcatacgtcgctcgccggcgcgccgacgacggggccgtggatcgtcaacgtgctcgcgatcgacccgtcgcgcgccggcgcggcgctgtcgctcgcgctgccgggcggcaacgatctcggtgcgggcggcgagacggtttcggccgcgcgggcgcgtgtgaacgcgctcgccggcgtcaacggcggctttttcacgaacatcaatccgttcggcgcgccgctgccgccgcgctcgcccgtcggcgcgacggtagtcgacgggcggctcgtcgcggccgcgatcggcaggcgccccggcctgctgctcgcgcgcgacgcgaacggccgccaacgcgcgacggtcgtgcgcaatctcgcgacggcgatcacgctgaccgacgcgcaaggccgtgcgatcgcggtccagacgctgaaccggccgatcctcggtacggtcgtcaattgcggcgcgcaggcgcgcacgccgacgagcgagccggcgcaggacacggtgtgcacgaactacgatgacctcgtgatgtacgactcgctatatctgcgcggcggtgcgtcgaacacgctcgtcgacgccggctaccagggcgcgcgatacgaactcgtggtcgacgcgaacggcgccgtcgtcgccggccatgcgacgctcggcgcgccgccgccgccgaacggctacgtgctgcaggggctcggcgcgagcgccgcgtggctgcaggcgcatgcgacgccgggcacgcgcctcgcggtatcgcgccggctgtcggccgacggcgcggatctcgcgctcgcgtcgggcacgtcgctcgtcgaggcggggccgacgctgtccgtgccgaatctcgcgcaaagcgccgcgcaagagggcttcgcgccgacggtgggcggcgtcgacgcgggcgaaggcgccgcggcgaacggcaactggtacaacggctggtatgtcgcgcgcaatgggcgcaccgcggcgggcgtcgcggcggacggcacgatcctgctcgtcgagatcgacggccggcagcccacgttgagcgtcggcacgagcattccggagacggcggcggtgatggcatggctcggtgcgacgtcggccgtcaatctcgacggcggcggctcgagcaacatggtggtcggcggcaagatggtcggacatccgtccgacgccgtgggcgagcggggcgtcggcgatacgctgatgctgctgccgggctga

SEQ ID NO: 1015 - DNA, 543 bp, Burkholderia pseudomallei
atgaaccgattttcattgcccccccgcccttcgcggatgcgcggcgccgtcgcggtggaattcgcgatcgtgatgattccgctcgtgctgctcgcaaccggcgtcgcggagttcggccgcgcgatctatcagtacgaggcgctgacgaaggcgacgcgcgacgcggcgcgctacctgtcgacgtacctgccgaccgatcccgcgtacccgctcgcgcaggcgcagtgcctcgccgtctacggcagcaccacctgcggctcgacgggcagcgagctcgcgccgggcctcgcgacgtcgatggtcgtcgtctgcgacgccgcgcacgcgcccgattgcagcgactcgtccgacccggcgcagttcgcgaacgtgccgacctacgacacgaacaacggctcgcccgacccggcgagcctcgccggcagcatgaatctcgtcgaggtcaagatcaagggctatcagtaccggccgattcccgcgtttccggggctgccgaacctgagcttcggcaacatcgtcaccgtgatgaggcaagtgtcatga

SEQ ID NO: 1016 - DNA, 984 bp, Burkholderia pseudomallei
atgaataagatgcgaaccaccgcgtcggcgctcgccgtctgcctgcttgcgagcggctgcgcgaccggccccaaccggcacccgggcgatccgctcgagccgatgaaccgcgccgttttccagttcaacgacgcggtcgactccgcgatcgccgtgccgatcgcgaagggctatcaaaaagtaacgcccacgccgctgcgcacggcgatcagcaatttcttctcgaatctcggcgatctcggcaacatcgcgaacaacctgctgcagctccggatcaccgatgcgacacaggacgtgatgcgcgtcgcgatgaactcggtgttcggcgtcgccgggctgatcgatgtcgcgtctctcgccgggctgccgaagcaccaccaggacttcggcctcacgctcgcgcgctggggcgtgccggccggcccgtatctggtgctgccggtcttcgggccgagctcgattcgcgacggtgtcggccgcgcggtcgacgtccgcttcaatctgctgaattacatcgagcctgccgcgcgcaatccgatgtacatcgcgcagttcatcagcgcgcgctcggatctgctcggggcgaccgatctgctgcagcaggcggcgctcgacaagtactcgttcgtgcgcgacgcatacgtgcagcagcgccgctcgctcacgtatcacggcagaagcgacgacgaatcgctgccgcactacgacgagcccggcggcgagccggcgggcggcccgggcggcggcgcgccgggcggcttgccgcaatacgaggatccgggcgagggcgcgggcggcatgccgccgggcggcgcgcgcgagcccgccggcctgccgcagtatcaggacccgggcgacgaagcggcggcgtcggcagcggcatccgccgcttcatccgcttcatccgcttcatccgcgtcgccggcgtcgtcagtcgcgccggcttccgcgtcgtccgcacagtctccgtcgtcgccgaactga

SEQ ID NO: 1017 - DNA, 435 bp, Burkholderia pseudomallei
atgagcaatgtgacgcgttacgacccgttttcgctggagcctgtgtccgatctgttccaaggtttgttccgtccgctgcgcggcatcgcggacgccgacgacgagaagctcgcgtcgatgaagatcgacgtgaccgaaaacgaccaggcctacgccgtcaaggccgagctgccgggcgtcgacaagaatgacatcaacgtgcagatcgacggcaataccgtgtcgatttccgcgaaggtcgagcgaaacaaggaactgaaggaaggcgagcgcgtgattcggcgcgagcgctattcgggcgagttcgcgcgaaccttctcgctcgcgaacgaactcgaccgcgacgcggcgagcgcgcagtatcaggacggcgtgctgtcgctgacgctgccgaagaaggcgagctcggagaagaagaagctgacgatcggctga

SEQ ID NO: 1018 - DNA, 2274 bp, Burkholderia pseudomallei
atgacaagaactcgctttgctttgcggcgcgtcgcaacggcgctcgtcgtcgccggaattgtcgccgcgcaggccgctcacgctcaggtcacgctcaatttcgtcaatgcggacatcgatcaggtcgccaaggcgatcggcgccgcgacgggcaagacgatcatcgtcgatcctcgcgtcaaggggcagctgaacctcgtcgccgagcgtccggtgcccgaagatcaggcgctgaagacgctgcagtccgcgctgcggatgcagggcttcgcgctcgtccaggatcacggcgtcctgaaggtcgtgccggaagccgacgcgaagctgcagggcgtgccgacctacatcggcaacgcgccgcaggcgcgcggcgaccaggtggtcacgcaagtgttcgagctgcgcaacgaatcggcgaacaacttgcttccggtgctgcgcccgctgatctcgccgaacaacacgatcaccgcgtatccggccaacaacacgatcgtcgtcaccgattacgcggacaacgtgcgccggatcgcgcagatcatcgcgggcgtcgacagcgcggcgggctcgcaagtcgccgtcgtgccgctcaagaacgcgaatgcgatcgacatcgccgcgcaactgacgaagctgctcgacccgggcgcgatcggcaacaccgacgcgacgctgaaagtcaccgtgcaggccgatccgcgaaccaatgcgctgctgctgcgcgcatcgaacgcgcagcgcctcgccacggcgaagaagatcgcgcagcagctcgacgcgccgagcggtgtgccgggcaacatgcacgtcgtgccgctgcgcaatgcggaagcggtgaagctcgcgaagacgctgcgcgggatgctcggcaagggcggcggcgaaagcggctcgtcggcgagctcgaacgacgcgaacgcgttcaatcagggcggctcgcaaagcggctcgaacttctcgacgggcgcatcgggcacgccgccgctgccgtcggggctgtcgtcgaattcatcgggcggcgcgggcggcacgacgggcggcggcgggctcggcaatgcggggctgctcggcggcgacaaggacaagggcgacgacaaccagccgggcggaatgatccaggcggacgcggcgtcgaattcgctcatcatcaccgcgtcggatccggtataccggaatctgcgggccgtgatcgaccagctcgatgcgcggcgcgcgcaggtgtacatcgaggcgctggtcgtcgagctgcaggcgacgaccagcgccaatctgggcattcaatggcaggttgcgaacaacgcgctctatgcgggcaccaatctggtgacggggcagaccggcctcggcaacagcatcgtcaatctgacggcgggagccgtgaccaatccgggcggcacgctggggtcgctgggctcgatcacgaacggcctgaacatcggttggttgcacaacatgttcggcgtgcagggtttgggcgccttgctgcagttcttcgcgggctcgagcgacgcaaacgtgctgtcgacgccgaacctcgtcacgctggacaatgaggaggcgaagatcgtggtcggccagaacgtgccgattccgacgggctcgtactcgaacctgacgagcggcacgaccgccaacgcgttcaacacatacgaccggcgcgatgtcggcctgacgctgcacgtgaagccgcaaatcaccgagggcggcattctgaagctgcagctgtacacggaagattccgcggtggtgcccggcacgaacacgacgtcggccaattcgcccgggccgacgttcacgaagcgctcgatccagtcgacggtgctggcggacaacggcgagatcatcgtgctcggcgggttgatgcaggataactaccaggtatcgaatacgaaggtgccgctcctcggcgacattccgtggatcggccagctgttccgctccgagggcaagacgcgccagaagacgaacctgatggtgttcctgcgccccgtgatcatcaacgaccgcgagaccgcgcaggcggtgacctcgaaccgctacgactacatccagggcgtgacgggcgcgtacaagtcggacaacaacgtcattcgcgacaaggacgacccgatcgtcccgccgatgccgctcggcccgagccagggcggctcgcccgcgatgaacctgttcgacctcgacaagatgcggcgccagcagctcgctccgcccgcgcccgccagcgcgccggcggcggcgagcgacgccggcaccgcgtcgccgggagcccgtccgtga

SEQ ID NO: 1019 - DNA, 729 bp, Burkholderia pseudomallei
atgaaaccagccgtccgctctgagcgccgcgcgcccggcgagaaacgcccgcggcgggcgcgccgcgccttccggcgaggcgcgcgccacggcgcgcgcggcttcacgctgatcgaaatgatgatcgcgatcacgattctcgcggtgatcgcgatcctgtcgtggcgcgggctcgaccagatcatccgcggccgcgagaaggtggcggccgcgatggaggacgagcgcgtgttcgcgcagatgttcgaccagatgcgcatcgacgcgcggcgcgcggcgaccgacgacgaagcgggccagcccgcggtgcgcgtcgcgggcgacacgctgcagatcgtgcgcgagttcgacgcgccgggcgcggcgccgcgcctgcaggtcgtgcgctaccggatttcgaacgggcgcgtcgtgcgttacgcgtcgccgccgatcggcgacgtcaacgcgctgcgcgacgcgctgcgcggcggcgataccgaaggctggagcgaggtggcgctgatgcgcggcgtcggcatgatcaacgcgcggctgtacgtgccgaaggtcggctggacgaccagcatgccggacgccgacaacgcgctcgagcagaacaacaacgcgctcaaggtgccgatgctcggcaacgcgccgccgccgcgcgcggtgacggggctcgaggtgagcatcggcgcgacgtcgctgcgcgtgccgatcacgcgcattttcctgatcggggagtga

SEQ ID NO: 1020 - DNA, 1128 bp, Burkholderia pseudomallei
ttgaaacgacaatacctggcactttccatcgcgacggccgcctgcgcggcgccgcaagcgcacgcgcagtcgagcgtccagctctacgggctcatcgacctgagcgttccgacctatcgctcgcacgcgaacgcgaagggcgatcacgtgatcggcatggggctcggcggcgagccgtggttcagcggcagccgctgggggctgaagggcgcggaggacatcggcggcggcacgaaggtgatcttccggctcgaaagcgaatacacggtagccgacggcaacatggaggacccgggccagatcttcgaccgcgatgcgtgggtcggcgtcgaaaacgacacgttcggcaagctcaccgcgggcttccagaacacgatcgcgcgcgacgcggcggcgatctacggcgacccttacggctcggcgaagctcacgaccgaggaaggcggctggacgaacgcgaacaacttcaagcagatgatcttctacgcggccggtgcgacgggcacgcgctacaacaacggcctcgcgtggaagaagctgttcggcaacggcatcttcgcgagcgcgggctacgcgttcagcaattcgacgagcttcgggcagaactcgacctatcaggtcgcgctcggctacaacggcggcccgttcaacgtgtcgggcttcttcagccacgtgaaccacgcgggctacgcgaacaagtcgttctcggtcggcggcaactacacgttcgacatcttccgcgtgaacgccggctacttccgctacctgggcgatcagggcgcgctcggccagcgccaggacaacgcgtggacggtgtcgttcaaggtcgcgccgaagggcgcgctcgactacgagctcggctatcagcagatgcgcgtgcacaacgccgcgtacaacagcgacggcaacgtgccgaacgcgaacatcggcgacttcagcctcacgtcgggcgtcggcaacggcttcaaggaaacgctgtacggctcggtgttctaccacctgtcgaagcgcaccgagctgtacctcgccggcgactacatgcgcctgcacggcggctatacggtcgcgtccacgcacggcgcgaccaatcagctcgagctgacgaccggcatccgcacgcggttctga

SEQ ID NO: 1021 - DNA, 1158 bp, Burkholderia pseudomallei
atgaaaacgatctggaagtttttcggtctcgcggccgctgtgtcggtgttacttgccggctgcggcggcgggggcgacaacagtgggcaaacgggcacgctgcacgtcgcgatgacggatgcgccgtcgtgcggttttgatcatatctatgtgaccgtcgcgaaggtgcgcgtcaacatgagtgcgcaagcaggcgacaacgattcgggctggaccgacgtcgcgctcgcggcgccgcaaaaggtcgacttgctgtcgctgaccaacggcgtgctcgccgacctcggccggaacgcgctgccggccggccagtaccagcaagtgcgcctcgtgctcgcgcagaaccagggcaacacgcttgcgaactcgatcgtgccgacgggcggcaccgagcagccgctcgcgacgccgagcgccacgcaaagcggctacaagatcatcacgccgttcacggtgcagccgaacacgctcgtcgatctcgttctcgacttcaatgcgtgcaagtcgatcgttcagcgcggcaacggcacgtacgcgctcaagcctgtcgtgaccgccacgccgacggtcgtcagcggcgcgatcgacggctatgtctcgccgaccgaagccggcgcgacggtctacgcggagcagaacggccacgtgatcaagggcacgctcgccgacagcaccggccacttcgtgctgacgccgctcgtgcagagctcgacgaacggcaactacgacatcgtgatcacgcagaacaacgtgtcgaccgggatcgtacgttcggtgcctgtcgtcgtgaacacgacgacgtcggtatcgacctcgtccgcgccgatcacgctgcccgcatcgacgatgaacatggtgagcggcacggccacggcgagcgcggatgcgatcctgcgcgcgctgcagatggtgaactcgctgccgtatgagattgcgtcgacgaacgcgaatctcgacacgggcgcctatgcactgacgctgccgaccgcggcgccgatcgtcggcacgtattcgggttcgctgccggtcgcgatgagcgcggcgccgagcgccgcgggccagtacacgatcgaggccgatgcggctaacggcgcgacgcagcagcagccggcgaacatcacggcgggctcggtctcgaacgtcaatttcgggttctga

SEQ ID NO: 1022 - DNA, 1956 bp, Burkholderia pseudomallei
atgtcaaccagcctttttcgagtatatcgcgcggtcgcggcgcccctcgtcgcgatcgcgctggccgccgtggcggccgcctgcgccgcgcagaccgccgacgaagcgtcgtcgaacgacgatcgggtgttcgtccagctgcgcgaggccgcgcgcaggaacgatccggtgcgcgccgcgcagctcgccgcgctgatcccgaattatccggcgccgtcatatctcgagtacttccagatcaagccgcagttgttcgattcggcgggccatgcgcgccttgacgcgccggacgcgccggtgctgtcgttcctgtcgcgctacgacggccaggcgatcgccgaccgcatgcgcaacgattacctgctcgtgctcggcgcgcgccatgactggcgcgccttcgacgagcagtacaagcgcttcgtgctcgacgacgacacgcaggtcaagtgctatgcgctcgaatcgcgcgcatcgcgtggcgagaacgtcgcggacatggcgcgcgagctgctcgtcgagccgaagtattacggcgacgcgtgcgtcgacctcatcacggcgctcgcgacgaacaagcagttctcgagcgacgacgtgtgggcgcaggtgcgcctcgcgtacgagcagaactacacgacgctcggcggcaagattgccgacgcgctcggcccgcgcccggtcggcttcgatcaggtgacgagcgcgccgccgctgttcctcgcgcgcggcgtgggctccgacgcgacgtcgcggcaactcgcgctcgtcgcgatcacgcgcatggcgcgcaacgatccggaagcggcggcggggcagctcgcgtcgctcgcgtcgacgctgtcggcggccgagcaggcgatcggctggggcgagatcggctatcaggcgacggtcaagcggctgccgcaggccgcgtcgtggtaccggaaatcgatggacgcgccgctgtcgaatccggcgtacgaatggcgtgtgcgcgcggcgctgctcgccggcgactggccgatggtgcgccgctcgatcgagcagatgcccgagcggctgcgcgacgacacggcatggatctactggcgcggccgcgcgctgaaggagagcggcgacaccctcaaggcgaaccaggagttcgagcgcatcgccgggcagttcaacttctacgggcagctcgcgggcgaggagctcggccagaagacgacgatcccgccgcgcacgaaggtgacggacgccgagatcgacgcgatgagcaaggtgccgggcttcgcgctcgcgcagcgcttctacgcgctgaacctgcggctcgaaggcaaccgcgaatggaactggccgctgcgcgggatgaccgatcggcaactgctcgcggcggccgagtacggcaagcgcgtcgacctgctcgaccgcacggtcaacaccgccgatcgcacgacggccgagcacgatttctcgctgcgctatccgtcgccgtatcgcgacatcgtcgagcgctacgcgcggaccaacgggctcgacgtcgaatgggcgtacgggctgatccgccaggaatcgcgcttcatcacgaacgcgcgctcgacggtgggcgcaggcggcctgatgcaactgatgccggcgaccgcgcaactcgtcgcgaagaagctcggcctcggcacggtctcgcgcgcgcagatgcacgacatcgatacgaacgtgcagctcggcacctggtatctgtccgacatctaccagaagttcgacgattcggccgtgctcgcgacggccggctacaacgccggcccgggccggccggcccaatggcggcaggtgctcacgcgccccgtcgaaggcgcgatcttcgcggagacgatcccgttcaacgagacgcgcgaatacgtgaagaacgtgctgtccaacgagacgtactacgcggcgctcttcgagaagaagccgcaatcgctgaaggctcgcctcggcttcatcgcgccgtaa

SEQ ID NO: 1023 - DNA, 1077 bp, Burkholderia pseudomallei
atgaagtcatccttcagccgcgcgctgcaaaccactttcgcgtgcgccgccgtggcggcgctggccgccggcgcttcgggcgcgtgcgcgcaatcgagcgttcagctctacgggcaggtcgacgaatggatcggcgcgcagaaattccccggcgggcagcgcgcgtggggcgtgcagggcggcggaatgtcgacgtcgtactgggggctgcgcggcaccgaggatctcggcggcggctatcaggcgatcttcacgctcgaggatttcttccgcgcgcagaacggccattacggccgcttcgacggcgacacgttcttcggccgcaatgcgtatgtcggactcgcgacgccttacggcacggtgcgcgccgggcgcctgacgacgcagctgttcatctcgacgatcctcttcaacccgttcatcgattcgtatgtgttctcgccgatggtctaccacgtgttcctcggcctcggcacgttcccgacgtatacgaccgatcagggcgtcgtcggcgattcgggctggaacaacgcgatcgactacacgagcccgagcttcggcggcttgaacgcggccgcgatgtacgcgctcggcaacacggcgggcgacaaccgctcgaagaagtggagcggccagctgaactattcgagcggcccgttcgcggcgacggccgtctaccagtacgtgaacttcaacggcggcccgggcgatctcggcgcgctcgtgtccggcatgaagagccagggcgtcgcgcagctcgggctgtcgtacgacttcaagcttgcgaagatctacgcgcaatacatgtatacgaagaacgaactgaacacgggaagctggcacgtgaacactgcgcaaggcggcgtatcggtgccgctcgggccgggcagcgcgctcgcgtcgtatgcgtattcgcgcgattcgggcgggcacgaccagacgcgtcgcacgtgggcgctcggctacgattatccgctgtccaagcgcaccgacgtgtatgccgcgtacatgaacgaccgctattcgggcatgtcgggcggcgacacgttcggcgcgggaattcgtgcgaagttctaa

SEQ ID NO: 1024 - DNA, 1440 bp, Burkholderia pseudomallei
atgaagcgagtgagactggccgcgctccttggcgcgagcgtcttcgcggcggcgggctgcggcagcgacgagccgaagacgccgggcgcgtcggacaacggcgcgcaaacgggcgccgcgcgcaacgtcatcttctttctgggcgacggaatggggatgacgacgctcacggccgcgcgaatctatgcgctcggcgaggacggcgcgctcacgctcgacacgctgcccgagaccgcgttcgtgaagacctattcgaacgatgcgcaggtgacggacagcgcgccgtcgatgtccgcatatatgacgggcgtgaagacgaacaacgaagtgatctcgatgacacccgacacgaaggcgatcgagccgagcgcgagtctcaccggcaactgcggcgcgaacaacggcaagccggtgccgacgctgctcgagatcgcgaaggcgaaggggctcgccaccggcgtcgtgacgacgacccgcgtcacccacgcgacgcccgccgcgacctacgcgcacgtgtgccaccgcgacgccgagaacgacatcgccgcgcagctcgtgccgggcggcgcgggctacaacgcggcgctcggcggcggcgtggatgtcgtgctgggcggcggcgcgcaattcttcgtgccgaaggaagcgggcggcaagcgcgcggacggccgccatctcgtgaacgagctgaaggcgaaggactacgcgatcgcgcagaaccgcgacgagctcctcgccgccgatgcgacgaagagcggcaagctcgcgggcctgttcgcgtcgagccacatgagctacgacctcgaccgcggcgcgacgaaagagccgagcctcgccgacatggcgacgcgcgcgctcgacgtgctgcagaagaacccgaacggctatttcctgatggtcgaaggcgggcgcatcgatcacgcgctgcacgacacgaacgcgaagcgcgcgctgcaggatacggtcgcgttcgacaacgcgatcaaggcgacgctcgacaaggtgcgccagaccgatccggagttgaagaacacgctcgtcgtcgtgacggccgaccacgatcacacgctggtgctcaacggctacgcggcgcgcacgggcaagacggaagcgggcaagccgggcgtgctcggcgtgctgcgcaactatcagacgggcgcggtcgcgaaggacgcggacggcgcgccgtacacgatcatcggcttcggcaacggcgagaaccgcgtgcaaggcagccgcgcgggcacgagcctcaccgacgcggtgacgggcgcggacgattatcgccaggaagcggtcgtgcgcatggccaagggcggcgagacgcacggcggcaccgacgtgttcctcggcgcgatcggccgcggcgcggacggctttcacggcgtgatcgagaacaacaaggtgttcgagctcgtgcgcggcgcggcgcagctctga

SEQ ID NO: 1025 - DNA, 1404 bp, Burkholderia pseudomallei
atgtcgactatcaagcgcatcgcggcggcggcgttcgccgcggcggccctctcgggcggtttcggccacgcggcgcacgccgcgggccaggcgaagaacgtgatcttcttcctcggcgacgggatggggccggccaccgtgacggcgagccgcctctacaaggtcggcgaagccggccaactgacgatggaaaagctgccgcgcaccgcgcgcatcaagaccttctcgaacgacgcgcagacgacggacagcgcgccgtcgatggccgcgtacatgaccggcgtgaagatgaacaacgaggtgctgtcgatgtcgccggacacgcgcgcgatcgcccccggcagcgacgcgaacggcaacaagacggtgaaccgctgcggcgtgggcaacggcacgccggcggcgacgctgctcgagctcgcgaaggcgcgcggcaaggcggtcggcgcgatcacgacgaccgagctcacgcacgcgacgcccgcggcgacttactcgcacatctgccatcgcgacgcgcagtacgacattgccgcgcaggccgtgccgggcggcgcgggctacaacgcggcgctcggcgacggcgtcgacgtgctgatgggcggcggccgcaatcactggacgccgtacgatccgctcgccaacaggcgcggccgcgcggacgggcgcaacctgctcgccgagctgcaggcgaagggctacgcggtggtcgcgacgaaggatcagctcgcgcaggcgggcgcgggcaagctgatcggccttttcagcacgacgagccatctcgaatacgagctcgaccgcgtcgcgggcaagggcgagggcgcgacgcagccgagcctcgcggagatgaccgcgaaggcgatcgacgtgttgcggaagaatccgaacggctatttcctgatggtcgaaggcgggcgcatcgaccacgcgctgcacggcacgaacgcgaagcgcgcgctcgaagacacggtggcgttcgacgaggcgatccgcaccgcgctcgcgaaggtcgatctgtcggatacgctgatcgtcgtgacggccgatcacgatcacacgatgacgatcaacggctattcgaagcgcggcaatccggtgctcgacatcagccgcaactatcgcgacggccagccgaacaaggacgcggacggcaacccgtacacgacgctcgtgttcggcaatggcgcgaaccggccgaacgtgcgcgtgccggtggattcgtcgacggcgacgaacgacgcgtatctgcaggaagtcggcgtgcgcatgggcagcgcgggttccgagacgcacggcggcggcgacgtgatgctgtttgccgacggcgccggcgcgaaggcgttcaagggcacgctcgacaacacgaaggtgttcggcctcgtgaaggccgcgttcgggttctga

SEQ ID NO: 1026 - DNA, 651 bp, Burkholderia pseudomallei
atggactggacatgctgcgaattcaggcatctgagttcgaacgagctttacatgatccttcgcacgcgcaatgcagtcctcgtcgtcgaagacgcgcacacgcatctcgacatcgacggcaaggacgaattcgcgatccacgtgttcgccaccgacaagcgcggcgagcagccggcgatcgccgcttacgcgcgcctgctgcccggtgacgacatcgatcccgaaacgacgatcgacaagatcctgacgagcgccgcgcaccgcgacgatcgcacgatcgacgcgctgatcgagcacgtgctcgcggccgcgcacgcacgctggccggatgcgccggtgcgcgtgcaggcgcccgcgccgcgcgaaggcttctacaaccgcttcggcttccgcaaggtcgacgggccgtatctcgagcatggcgcgccgtacgtcggcatgctgcgcgcggcgagcgccccgtcgaaggccgtgcgcaatctgctcgatctcgtcggcaacgcgacgggcgccaatcccggcacgagcgcgggcgcggtgcccgcgagcgccgcgcgcaaaccgcgcaaggccaacgccgaatccaccaccgaaggcgaacgctatgcgttcgccggccgtttgccggccgactccggaatgaaccgatga

SEQ ID NO: 1027 - DNA, 780 bp, Burkholderia pseudomallei
atgcgcttcgtccgctccctgctgctgttcgtctatttcatcgtctatacggtgccgtacgccaccgcatgcttcatcgcgttcccgttcatgcggccgaacgcgcgctactggatggcggtcggctggtgcaaatcgacgctgttcgtcgcgcgctggctcacgggtatccggtaccgcgtcgaaggctacgagaacctgcccgacggcccggccgtgctgctgccgaagcatcagtccgcatgggagacgatcgcgctgcccgcgctgatgcccaagccgctctgctacgtgttcaagcgcgagctgctgtacgtgccgttcttcggctgggcgctcgggatgctgcacatggtccacatcaaccgcaaggacggcaagaacgcattcgattcggtgatccgccagggccgcaagcggatggcggaaggcgcgtgggtcatcatgttccccgaggggacgcgcacgccggtcggcagccagggcaagtacaagacgggcggcgcgcgcttcgcgatcggcgccggcgcgcccgtcgtgccgatcgcgcacaacgccgggcgcgtgtggccgcgcaactcgttcacgaagtaccccggcaccgtcacggtgtcgatcggccagccgatcgacacgcaaggcctcacccccgaccaattgaacgaacgcgtcgaaaactggatcgaagcggaaatgcgccgcatcgatccgcacgcgtaccggcacgagcgcgacggcgcacgcggcgccgcccgcgcgtccgacgccgcgcatccctga

SEQ ID NO: 1028 - DNA, 315 bp, Burkholderia pseudomallei
gtggctcgcggcagaatcatccccggcgcgtatgcgatttcggagaccacctccgctcgactgcgccaagaataccccggactcgaccattggagcatcagcgagtttcagctcgcctggggaaactacgcaagagaattgcgcggcgacgccggcatgacttttgatcgcgacgaggttttcctcgtatatctgcacatcgtgcgaaaagaccggacattcagcttcgctggcgaccgcggcatgccgggcacttgggaagcttacgcgcaagaaaaaccgtgggagacggatgcgccgttgccggtcatttaa

SEQ ID NO: 1029 - DNA, 519 bp, Burkholderia pseudomallei
ttgcgcgctcgcggtttcacgctgatcgaattgatgatcgtgctcgcgatcgtcggcgtcgtcgccgcgtacgcgattcccgcctatcaggattatctcgcgcgcagccgggtcggcgaggggctcgcgctcgccgcgtccgcgcggctcgcggttgccgagaacgcggcgagcggcaatggattctcgggcggctacgtgtcgccgcccgccacgcgcaacgtcgattcgatccgggtcgacgacgactccgggcagatcgtcgtcgcgttcacgacgcgcgtggcggcggcgggcgcgaatacgctcgtgctggtgccgtccgcgccggatcaggcggatacgccgacggcgcgtgtcgcgttgtcgaagggcgccgtccaggcgggggcgatcacgtgggaatgctttgccgacggcaaggcgtcgtcgtcgctgcccgcgccgggcgccggcccgctgccgaccgatgcgccgacgctggccggcaagctggcgccccccgagtgccgcgcgtga

SEQ ID NO: 1030 - DNA, 1263 bp, Burkholderia pseudomallei
atgcgcgtcgaacgggttccataccgcttaatcactgtcgcgacggctgccgttttcctggccgcgtgcggaaaaaaagaatcggctccgccccctcaaacgcccgaagtcggcgtcgtcaccgtccagccgcagcccgtgccggtcgtctccgaactgccgggccgtacgagcgcctatctggtcgcgcaggtgcgcgcacgggtcgacggcatcgtgttgcggcgcgagttcacggaaggcagcgacgtcaaggccggccagcgcctgtacaagatcgatccggcaccctatatcgcgcaattgaacagcgcgaaggcgacgctcgcgaaggcgcaggcgaacctcgcgacgcagaacgcgctcgtcgcgcgctacaaggtgctcgtcgccgcgaacgcggtcagcaagcagcagtacgacgatgcggtggccgcgcaagggcaggcggccgccgacgtgggcgcgggcaaggccgccgtcgagaccgcgcagatcaacctcggctatacggatgtcgtctcgccgatcacgggccgcgtcggcatctcgcaggtcacgccgggcgcgtacgtgcaggcgagccaggcgacgctgatgtcgaccgtccagcagctcgatccggtctacgtcgatctcacgcagtcgagcctcgacggcctgaagctgcgccaggacatccagagcgggcgcatcaagacggaaggcccgggcgcggcgaaggtcacgctgattctcgaggacggcaagccgtacccggagcggggcaagctgcagttcagcgatgtcacggtcgaccagacgacgggctcggtcacgatccgcgcgatcttcccgaacaagcagcgcgtgctgctgccgggcatgttcgtgcgcgcgcgcatcgaagagggcgtcaacgagaacgcgttcctcgttccgcagatcggcgtcacgcacgatccgaagggccaggcgatcgcgatgatcgtcgacggcaagggcaaggtcgagccgcgcgtgctggtcacgggcggcacgcagggccagaactgggtggtcgagagcggcctgcaggcgggcgaccgcgtgatcgtgcagggcatcgacaaggtgcgcccgggcatgaccgtgaaggccgccgaggctcaactgccggccgcggcggccggcgcgtcgggtgccgcgcccgcgggcggctcgcccgcccaggccgcggcggcgagcgcggccgcgtcgggtgccgcgccgtcgagcgctgccgccgcgtcgagcgcgcaataa

SEQ ID NO: 1031 - DNA, 1270 bp, Burkholderia pseudomallei
atggcactctcacgaggcactcgcactttgatcggtgcaacgctttgcgcatccgtgacgctgatgaccgccgcttgcggcggctccgacggctcgggcgcgcccggcgccagcattttcaagtcgccgcacggctcgggctcatcgagtaccacgggcacgagcggcaccaccacgagcggcaccggcggcacgagcaccggcagcacgcagaccacgatggcgctgcagatggcggacttcatcctcgctcagcaggacagcaatggcgcgattccggacgaagcgggcagcggcaccgccaatacggactccgatatggaatacgcgctgatcggccttgcggccgcgtacggcgcgacgcatgacgcgaagtacctgaacggtctcgagaagggcatcgcctggctcgccgcgcgcgaggagatgaccgatccggcctggaggggaagctggcgctatgtgtattcgatgacgccgccgtacgatccgatcccgacgtcgccgggcgccggcattgccgacgtgcgcggcgtggacgcgacgtccgcgctgttcgtctacctgctctatctcgaccggcaactgacgggcagcagcgcgctcgtcacgcaatacggcgccaatgcgcgcgcggcgctcgatttcgtgctcgcgaagaacatcaatccgagcggctactcgggcagctcgtggcaactgcccgtcggcagcaccacgtggcagttctggccgtacgagtacgcggcggatcagggcgatgtctatctcggcatgaacgggggcgcgctgctgtttccggacaatccgaactacgcggcgaaggcggctttcctgaggaacaacgtgccgtcgcagttctacatgacgggcgcgcagcgttattcggtcggccgcgatacgggagcgccgctcgattcggacctcggcatcgatacgatctttccgcagggctatctgccgtgggtgttcggcgcgaattcgcagagcatcggctcgatccagtggatgatcaaccagacggccgccgacggcagcatccgttcgccgtcgaccgaccccgcgtacgcgctgtccaacgtgatcctgctgctcggcgcgccgacccagggcatgcaggcgccgtcgacgacgctgccgtggatcgtgaacaacgtgctcgatccgcagacgtacggcatccacgactaccccggctcgccggaccaggagacgaacgtctccgggttcgcggtcgcggcgttgctcgggacgaaggcgttcccctgac

SEQ ID NO: 1032 - DNA, 981 bp, Burkholderia pseudomallei
atgagctccaccgatacgttgtccggccaggttgccgcggccgacgccgagatcctgctcgcccagccgcgcggcttctgcgcgggtgtcgaccgcgcgatcgagatcgtcgagcgtgcgattgcgatgcacggcgcgccgatctacgtgcgccacgagatcgtgcacaacaagtacgtcgtcgaggatctgaagaagaagggcgcgatttttgtcgaggaactcgaggaagtgccgtccggcaacacggtgatcttcagcgcgcacggcgtgtcgaaggcggtgcgcgacgaggcggccgtgcgtgggctgcgcatctacgatgcgacgtgcccgctcgtcacgaaagtgcacgtcgaggtcgcgaagatgcgccaggaaggcgtcgacatcgtgatgatcggccacaaggggcatccggaggtcgagggcacgatggggcaggtcgagcgcggcatgcacctcgtcgagagcgtcgaggacgtgcgccggctcgagctgcccgatcccgagcgcgtcgcgctcgtcacgcagacgacgctgtccgtcgacgacgcggccgagatcatcggcgcgttgaaggcgaagtttcccgcgatccgcgagccgaagaagcaggacatctgctacgcgacgcagaaccgccaggacgcggtgaagttcatggcgccgcagtgcgacgtcgtgatcgtcgtcggcagcccgaacagctcgaattcgagccgcctgcgcgaggtcgccgagaagcgcggcgtcgccgcctacatggtcgacgcgcccgagcagatcgatccggcctgggtcgccggcaagcgccggatcggcgtgaccgccggcgcgtccgcgcccgaggtgctcgcgcaggccgtgatcgcgcgcttgcgcgagctcggcgtgaccaacgtgcgggcgctcgagggcatcgaggagaacgtgtcgttcccattgccgcgtggcctgaatctgtcttccgccgcctga

SEQ ID NO: 1033 - DNA, 648 bp, Burkholderia pseudomallei
atgaataccaaaatcgcgacgcgcttgtccgttttcgctctcgccggcgccctgctggcgggttgcgcaacccagcaaggcaccaacacggctgtcggcaccggcacgggcgccgcgctcggcgcgggcatcggcgcgctcgctggcggcggcaagggcgcggcgatcggcgccggcgtcggcgcgctcgtcggcggcgtgacgggttacaactggcaagcgatcaagaacaagctcgcgccgtcggcgcagcaaacgggcacgcaggtcaccgaacagccggacggctcgctcaagctgaacgtgcccagctcggtcacgttcgcgaccgaccagtacgcgatcacgccggcgttcacgccgctgctgaacgacctcgcgacgacgctgaaccagaacccgcagatcaccgcgtcggtcgtcggctacaccgacagcacgggctcggccgcgcacaatcaaacgctgtcgcaaaatcgcgcgcaaagcgtcgtgaacgcgctcgcgcagcgcggcgtcgcggcgaaccgcctgtccgcgcaaggcatgggcgcgtcgaacccgatcgccgacaacgcaacggaagccggccgcgcgcaaaaccgccgcgtcgagatctacctgcgcgcgccgcaagcggcgcagtaa

SEQ ID NO: 1034 - DNA, 528 bp, Burkholderia pseudomallei
atgagcttcagcaatgttccggccggcaaggatctgccgcaagacttcaacgtgatcatcgagatcccggcgcaaagcgagccggtcaagtacgaagccgacaaggcgctcggcctcctcgtcgtcgaccgcttcatcggcaccggcatgcgctacccggtgaactacggcttcatcccgcagacgctgtcgggcgacggcgaccccgtcgacgtgctcgtcatcacgccgtttccgctgctcgcgggctcggtcgtgcgtgcgcgcgcgctcggcatgctgaagatgaccgacgaatcgggcgtcgacgcgaagctcgtcgcggtgccgcacgacaaggtctgcccgatgacggccaacctcaagtcgatcgacgacgtgcccgcgtacctgaaggatcagatcaagcacttcttcgagcaatacaaggcgctcgagaagggcaagtgggtgaaggtcgagggctgggacggcatcgacgccgcgcacaaggaaatcaccgacggcgtcgcgaacttcaagaagtaa

SEQ ID NO: 1035 - DNA, 381 bp, Burkholderia pseudomallei
atgagccctgacaccgcccgccgattcgataccgaattcgcgccgcgcatcgcgcgcgccatcgccgatttgctgaaccatcgggcgcacaccgacgtcgtcggctacggcggccacggccatccgacgcaggtgcggatcgtcgcgccgcacgccgagcacgtgcgcggctacgcacacccgctgaacctcgcgctcacgtggaacaccgacgagatcgaacgcctgatggaagcggacggcgccgcacgcttcgagcgctatctggcggcgctgccgcgcaagctggcggcatgggaaaacgcgcgcggcgtcgatttcggctcgcgcacgcaggccgacgcgctcgtactactcggcgggctcgatttcgaggcatga

SEQ ID NO: 1036 - DNA, 1236 bp, Burkholderia pseudomallei
atgacccgacgcgctcacgcgccttcgccgttcgctttcccgctcaggctgagccactggatgaaaggtttcgcgctcgcgctgccgcttttcggcaatcccgccttcgcgcaggacgcaagcgccggccccgcgggcggcgtgtacaacctgctcgtcggcacctacacgggctcgggcagcgacggcctctacgtgtatcgcttcgataccgactcgggccgggtgagccccgtgtcgtcggcgaaggccgagaacccgtcgtacctcgtcgcgagccgcgacggccgccacgtgtatgcggtcaacgaactgccgggtgacgcgggcccggcgagcgtgcgcggcggcgtcagcgcgttcgatttcgacgcgaagacgggcgcgctcaagttcgtcaaccgcgtatcggcgcaagggaacgatccgtgttacctgagcctgtcgccggacgggcggtatctcgtcgtggcgaattactcggtcgcgtccgatccgggcggcagcttctcggtgttcccggtcgaggcgacgggcgcgctcggcgccgcggtgctgaacgtgcatcacgagggcacgggcccggtgaaggggcggcaggacggcgcgcacgtccattcgaccgtgttctcgccggacggcaagtacctgttcgtgcaggatctcggcgcggacaagctctattcgtaccgctacacgccggacggcagccgcggcctcatcggcccgaccgagtcgcgctacacgctcgcgaaggcgggctcgggcccgcgccatctggtgttcggcgcaaatgggcggttcgcgtacgtgaccaacgagctgaacgcgtcggtcgacgtgtatcgctacgacgacggccggctcgcgcacgtcgagaccgtgccgatgacggcgccgggcttcgcgggcaaggtgggcggcggcgcgctgcatctgtcgccggacgggcgcttcctgtacgcgaccaatcgcggcgacgcgaacgacatcgtgatctacgcggtgaacgcggccgacggcaagctgacgctcgtcggccggcagtcgagcctcggcaagacgccgcgcgagttcgcgatcgacccgagcggcaagtggctcatcgtcggcaaccaggacagcgacagcgtgttcgtgttccggcgcgacatcgcgagcggccggctcgagccgaatccggcgcggatcaggatcgacaagccggtcgatttcaaattcgtgccggtgcagtga

SEQ ID NO: 1037 - DNA, 2142 bp, Burkholderia pseudomallei
atgtctctgttcaataaaatcgtgaaggaattccagtggggccagcacaaggtgcgcctcgaaaccggtgaaatcgcgcgccaggcaagcggcgccgtgatcgtcgacatcgaggacaccgtcgtgctcgcgaccgtcgtcggcgcgaagtcggcgaagccgggccaggatttcttcccgctcaccgtcgactacatcgagaagacctactcggccggcaagatcccgggcggcttcttccgccgcgaaggccgtccgtcggagcacgaaacgctgacgtcgcgcctcatcgaccgcccgctgcgcccgctcttccccgaaggcttctataacgaagtgcaggtcgtgatccacgtgctgtccgtgaatccggagattccggcggacatcccggcactcatcggcgcatcggctgcgctcgccgtgtccggtctgccgttcaacggcccggtcggcgccgcgcgcgtcgcgtacgtgaacaacgaatatgtgctgaatccgacgcgtgagcagatcaaggcgtcgcgcctcgatctcgtcgtcgcgggcacggagcgtgcagtgctgatggtcgagtcggaagccgaccaactgccggaggacgtgatgctcggcgcggtggtgttcggccacgagcagatgcaaacggcgatcgacgcgatccacgagctcgtgcgcgaaggcggcaagcccgagtgggactggcagccggcgccgaaggacgaggcgctgaacgcgcgcgtgaccgaactcgcgcagccggagttgctcgccgcctaccagatccgcgacaagcaggcgcgctcgacgaagctgaaggaagtgtacgcggcgacgtcggcgaagctggaggaagaagcggtggcggccggcacggtcgcggcggacaaggcgaccgtcggcaacatcctgttcgacctcgaggcgaagatcgttcgcggccagatcctgaacggcgagccgcgcatcgacggccgcgacacgcgcacggtgcgcccgatcgaaatccgcacgggcgtgctgccgcgcacccacggctcggcgctgttcacgcgcggcgagacgcaggcgctcgtcgtcgcgacgctcggcacgaagggtgacgaacagatcatcgacgcgctcgaaggcgaataccgcgagcgcttcatgctccactacaacatgcccccgttcgcgaccggcgaaacgggccgcgtcggctcgccgaagcgccgtgagatcggccacggccggctcgcgaagcgcgcgctcgtcgcgtgcctgccgagcgccgacgaattcggctactcgattcgcgtcgtgtcggaaatcaccgaatcgaacggctcgtcgtcgatggcgtcggtgtgcggcggctgtctcgcgctgatggacgccggcgtgccgatgaaggcgcacgtcgcgggcatcgcgatgggcctgatcctcgagggcaacaagttcgcggtgctgaccgatatcctcggcgacgaggaccacctcggcgacatggacttcaaggtggccggcacggcggacggcgtgaccgcgctgcagatggacatcaagatccagggcatcacgaaggaaatcatgcaggtcgcgctcgcgcaggcgaaggaaggccgcatgcacatcctcggcaagatgaaggacgcggtcgcgggcgcgaacacgcaactgtccgaattcgcgccgcgcatgatcacgatcaagatcaacccggaaaagattcgcgacgtgatcggcaagggcggctcggtgatccgcgcgctgaccgaagaaaccggcacgacgatcgacatctcggatgacggcgtcgtgacgatcgcgagcacgaacagcgaagggatggccgaggcgaagaagcgcatcgagaacatcacggccgagatcgaagtcggccacgtgtacgaaggcacggtgctcaagctgctcgatttcggcgcgatcgtgaacctgctgccgggcaaggacggcctgctgcacatctcggaaatcgtcaacgagcgcgtgaaggacatcaacgactacctgaaggaaggccagcaggtgaaggtcaaggtgatccagacggacgagaaggggcgcgtgcgtctgtcggcgaaggcgctgctgaacgaggcggccgcccaggcggatacgccgccgcagcagtaa

SEQ ID NO: 1038 - DNA, 996 bp, Burkholderia pseudomallei
ttgcgttgctgtttgccccgccgtttgcccttgacgatgccgctgaatccgaagatcgcgcaggtgctcgacatgatcgagcgcgccaagcgtcccgattatcatgaacagacgcccgcgcaggcgcgcgccgcgtacgagaagagcgcgccgatcctcgacgtcgcgcccgcgccgatgttttcggtcgaagacctgcgcgtgccgtcgcgcgacggcggcgcgttcggcgcgcggctctatctgcccgtcgagccgagtctcgccgagccgctgcccgtgctcgtctactaccacggcggcggcttcacggtcggcagcgtgaacacgcacgacgcgctgtgccggatgttcgcgcgcgatgcgcagtgcgcggtactgtcggtggattaccggctcgcgccggagcacaagttcccgaccgccgtcgacgacgcggaggacgcgctcgtgtggctgcatgcgcacgcgtcgcgcttcggaatcgattcggcgcggctcgcggtgggcggcgacagcgcgggcggcacgcttgcgacggtgtgcgcggtgctcgcgcgcgatcgcgggatcgcgctcgcgctgcaactgctgatctatccgggcacggtggggcatcagcagaccgaatcgcacgcgcggctcgcgaaaggctatctgttgtccgcggacacgatccagtggtttttcgggcattacgtgcgcgatgcgtcggatcgcgacgactggcgcttcgcgccgctcgacggcacgcgcggcgcgccgtcgttcgagcgcgtcgcgcccgcgtggatcgcgacggcgcagtacgatccgctatccgacgaaggcgaagcgtatgcggacaagctgcgcgcggcgggcaaccgcgtgacgctcgtcgcgtacgcggggatgattcacgagttcttcaagatgggcggctacgtgccggaggtgcggctcgcgcatgcggacgcggtgggcgcgctgcgcgcggcgttcgacggcgattga

SEQ ID NO: 1039 - DNA, 588 bp, Burkholderia pseudomallei
atgcacaaacgcaatctcgtgttgaaagccgccgccgcgctcgtcgtgggcagcctggcgctcgccggttgcacgacgacgccggacaagcccgccaatgccgcgaccaacgcgtcgaagcgtcaagccatcgatgcgagcgtcgacgcgacgctgtcgcgcctgtactcgacggtgcgcggctcgcgcgaactcgtcgcgaagtcgcgcggcgtgctcgtgttcccggacgtgatccaggcaggcctcatcatcggcggccagaccggcaacggcgcactgcgcgtcggcggcgctacggtcggctactacaacacgtcgtcgctgtcggtcggcctgcaggcgggcgcgcagtcgaaggcgatcgtgttcctgttcatgacgcaggacgcgctcgacaaattccgcaactccgacggctgggcggcaggcgccgacgcatcggtcgcgctcgtgaagatgggcgcgaacggcgcgatcgacacgacgacggcgaccgcccccgtcgaagtgatcgtgctgacgaacgccggcctgatgggcgacgtgtcgatcagcggcacgaaggtcacgaagctgaagatctga

SEQ ID NO: 1040 - DNA, 1146 bp, Burkholderia pseudomallei
atgaatctgctgaaacgttacgctgcacccgttgcctgcgcggcggccgtcctggttttcgcggcctgttcgtcaacgaaggacgcgcgccgcgtgccgacgccgctcaccgagttcaaacccgtgctcgacgtgcagcaggtgtggacggcgagcgtcggcaagggcggccgctactcgttctcgcccgtcgcggtgggcgacgccgtgtatgtcgccggcgcgaacggttcggtcgagaagatcgacgcgaagacgggccagcaagtctggcgtacgaagatcggctcggacttgtcggcgggcgtcggcagcgacggcaacctgaccgcggtcggcgcgctgaagggcggcgtgttcgtgctcggcccggacggcaagcagttgtggaaagccaccgtgcaaggcgagatcttctcgccgccgctcgtcggcaacggtctcgtgatcgtgcgcacgatcgacggccaggtgatcgcgttcgccgcgcagacgggcgagcagaagtggacttaccgcaaccgcgcggtgccgctgaacctgcgcgtgtcggccggcatgacgttcgcgggcgacgccgcggtgctcgcgggcttcccgggcggcggcctcgtcgcgctgaacctgcagacgggcgagccgttctggcagacgcccgtgtcgtttccgaaaggcgtgaccgaagtcgagcggatcaacgacgtgacgggcgcgccgacgctcgtcggcgccgagacgtgcgcggtgacgttccaggggcagctcggctgcttcgatgcgaactcgggccgcccgttgtgggaaaagccgttttcgagccgcagcggcgtcgcgcaggacgatacggtcgtcgtgggcggcgacgactggtcggtcgtgtcggcttacgacgtcgcgacgggcaaggcgctctggcgcaacgacaagctgaagagccgcgacgtcggcgtgccgtacctgctcggccgcgcggtcgtgctcggcgactacaagggcttcgtgcatttcctgtcgcgcgatgacggcacgttcgtcgcccggatgaagacggacggcagcgcgatcgccgccgcgcccgtgcttgccggcaacacgctcgtcgtcctgacgcaggacggcggcgtatacggtttccgtccgcgctaa

SEQ ID NO: 1041 - DNA, 636 bp, Burkholderia pseudomallei
atgcccaactcactcgaagctcagattcgccaggccatgaaaaccggcagcaccctcacgatcgaattcgatcaggcgctcaaccagaaatcgcccggcaccttgaatgtctttcttcatccggccaatggcggcgtcaggatcgatctcgattcgggcaatcaaggcgaacccgcgaaaatactgtggctgccgtggaagcaaggcgaactgcaaacgttgcaacccggctcgatctcgaccgtggacatgctgttcttcacctactacctgagcggctgcaaggtattcgccggcgatggggggccggtctggcacatcgacgcgccggtcgaagccaatcagttctggcgccgcatgtcgagcgacgaatggatggaggactgggaagtcggcaccgatcgtcaggtggcgtacctgcatcgcgcgggccaaagcgacagcctgtggaatctgtccgcgtatctcgaaggcgctgcgccgagcacgtatggacgcgacaatctggggcaggccgtggtgggcgggatcgtcaccggtcggcagcaaatgagcctgtaccagtacgcgacgacgtcttcgggctcgtccgcctggagcccattgacatacaccctccagcagcgcaagcaatag

SEQ ID NO: 1042 - DNA, 372 bp, Burkholderia pseudomallei
atgaacgaagcacgcgccgcccgcgcccagggcgcacccggctcgcgccgatgtgggccggacggtcggtccgtagccaggccagtactggcgattgtcgttgccgcgtcggtcgtctcgccggcgatcgccatcgcgccggtcgccgtagccgccgcgatcgtcgcgccgatcgtatggcggcgcatgcgtgcgctcccattcgtcgcgctcccagtagcggtggccgtcccaatagcgatcgccgtgtcagccgatgcggacgtccacgccgacggcgggctccgtcggatacaccgcgccccccgcgagcatcgcgctcgcgaggagcggcggaatgatcagtcctttcattgtcggccgcccctgtga

SEQ ID NO: 1043 - DNA, 1251 bp, Burkholderia pseudomallei
atgccgatcccccacgccctcgcgacgctcgccgcggccgcgctgctgatgcacgccgcgtgcgcggcgacgcttgccgtccacccgggcgagcgcatcggcgcggcgctcgccgccgcgcggccgggcgacacggtgctcgtccagcacggccgctacgaggagaacctgagaatcgacaagccgctcacgctgcgcggcgtcggccgcccgacgatcgacgggcgcctcgcgggcgacgtgatccgcgtcgccgcgccggacgtgacgatcagcggcttttcgatcgtcgacagcggcgcgagcctcaccgcgcaaaacgcgggcgtctacgtggcgcccggctccgatcgcgcgcgaatcgagcgctgcgagctcgtctacaacctgttcggtctctggatcgagcgctcggccgacgtgcgcgtcaccggcaacgtgatcgtcggcaagcgcgatttgctgtcgcccaggcgcggcaacggcatccagctctacaacacgacgggcgcgcgcatcgccggcaacacgatcagctacacgcgcgacggcatctatgtcgacgtgtcgcatcacgcgcgcttcgagcacaacacgatccacgacgtgcgctacggcacgcattacatgaactcgtactacaacgtctgggacggcaacgacgtctatcacaaccgcggcggcctcgcgatcatggaggcgcgcgaccagatcgtgcgcggcaaccgggtatggggcaacaccgatcacggcatcatgctgcgcacgatccaggattcgctgatcgagaacaacgtcgtcgccggcaaccagcgcggcctgttcatctacgacgccgaatacaacacgatccgcggcaacctcgtcgtcgacaacaagatcggcgtgcatctgtggggcggctcgatccacaacgacgtgacgggcaacgatttcgcggacaaccgcgagcagatccgctacgtcgcggcgagcgacgtcgcgtggcccggcaactactggagcaactacctcggctgggaccggcgcggccgcggcgtcggcgacgtgccgtacaaggcgaacgatctcgtcgaccggctgacctggcgcgtgccgtcggtcaaggtgctgatgaacagtccggccgtgcaggcgctgcgcgtcgtcgcgcggcagtttccgctgctcgcggtgccgagcgtcgtcgacgacgcgccgcgcatgcgcgccgtgcacgccggctggccgcaatgggtgggcaagcgatga

SEQ ID NO: 1044 - DNA, 531 bp, Burkholderia pseudomallei
atgaaagcaaaaggaatgcaatacggtctgacggccgttctgctgtcgatgctctcaggcggcgcggcttattcgcagaccgcgacgaccggcaccatcaatttcaccggcagcatcaccgacgtgccgtgcgaaatcgacacggccgccacgagtagtaacgtgacgatggccaaggttttcgcgaacgacttcagcggcgtggggtcgaccaccggcacgacggcattcaagatcgtcctcaagaattgcggcgcgtcgacgagcggcgcgacggtgcgcttcatgggcacgactgacagcgccaatcccgcggcgctccagacgaccgcgggcggagcgggaggggtcgcgttgcagctcgtcgacgacaccggcacgccgatcagtatcggctcgagcagcaaggcatacacgattgccgagggcgacaacacgttcaatttcgcggcgcgctatatcgcgacgtccgcgaccgtgacgggcggcgcggccaatgccacggcggtattcgcgctgacgtacaagtag

SEQ ID NO: 1045 - DNA, 3375 bp, Burkholderia pseudomallei
atgaacaggattttcaaatcgatctggtgcgaacagacgcgtacgtgggttgcggcatcggagcatgccgtagcgcgcggtggccgcgcgtcgagcgtcgtcgcgtccgccggcggattggagaaagtgctcaagctgtcgattctgggcgcggcatcgctgattgcgatgggcgtggtcggaccgtttgccgaggaggcaatggcggcgaataacgccggtgtgtgtttgacgtacaacggtagtagcaacaatacatcaggtactggcggctggttcgctgatggttgtaaatcggccggctgggtgcagggcatggttacgaatagcaagacggattgggtcgggctgaccgcggacgacacgcagatcgtgctcgacggtagcgcgggcagcatttacttccggacgggcggcataaacggcaacgtgttgacgatgtcgaacgcgaccggcggcgtattgctcagcggcctcgcggccggcgtcaatccgaccgatgcggtcaacatgtcccagttgacctcattgtcgacgtcgacggcaaccggcatcacctcgctttcgacgtcgacggcaaccagcatcgcttcgctttcgacgagcatgctgtcgctcggcgtgggcgtcgtgacgcaagacgcctcgaccggcgcgatcagcgtcggcgccaattcgccgggcctgacggtggatttcgcggggggccagggcccgcgcacgctgacgggcgtcgccgcgggcgtcaacgctacggacgcggtcaatgtcggccagttggcgtcgctgtcgacgagcacggcagcggggctttccactgccgcgagcggcgtcgcgtcgctgtcgacgtcgctgctcggcgcggtgggcgatctggcgtcactgtcgacgagcgcatcgacggggctcgccactgcggatagcggcatcgcgtcgttgtccacgtcgctgctcggcaccgcggacaacgtgacgtcgctgtcgacgagcctcagcacggtcaacgcgaatctggccggcctgcagacctcggtggacaacgtcgtgtcatacgacgatccgtcgaagtcggcgatcaccctcggcggtgcgggcgtcacgacgcccgtcctgctgacgaacgtggctgcggggaagatcgccgcgaccagcacggacgcggtgaacggttcgcagctttacacgctccagcaggagttctcgcagcagtacgatctgctgacgtcgcaagtctcgtcgctcagcacctcggtgtcgggtctccaaggcagcgtctcggcaaatacgggaaccgcgtcgggtgacaacagcacggcgagcggtgacaacgcgaccgcgtcgggcacgaacagcacggccaacgggacgaactcgaccgcgtcgggtgataacagcacggcaagcgggacgaatgcgtcggcgagcggcgagaacagcacggcgacgggtacggactcgaccgcatcgggcagcaacagcacggccaacggcacgaactcgaccgcgtcgggcgataacagcacggcgagcgggacgaacgcatcggcgacgggtgagaacagcacggcgacgggtacggactcgaccgcatcgggcagcaacagcacggccaacgggacgaactcgaccgcgtcgggcgataacagcacggcgagcgggacgaatgcgtcggcgagcggcgagaacagcacggcgacgggtacggactcgaccgcatcgggcagcaacagcacagccaacgggacgaactcgactgcgtcgggcgataacagcacggcgagcgggacgaacgcatcggcgacgggtgagaacagcacggcgacgggcacggattcgaccgcatcgggcagcaacagcacggccaacggcacgaactcgaccgcgtcgggcgataacagcacggcgagcggcacgaatgcatcggcgacgggtgataacagcacggcgagcggcacgaacgcatcggcgaccggtgagaacagcacggcgacaggcacggattcgaccgcatcgggcagcaacagcacagccaacggcacgaactcgaccgcgtcgggcgataacagcacggcgagcggcacgaacgcatcagcgaccggtgagaacagcacggcgacgggtacggactcgaccgcatcgggcagcaacagcacggccaacggggcgaactcgaccgcatcgggcgataacagcacggcgagcggcacgaacgcatcggcgacgggcgagaacagcacggcgacaggcacggattcgaccgcatcgggcagcaacagcacggccaacggaacgaactcgactgcgtcgggcaacaacagcacggcgagcgggacgaacgcgtcggcgacgggtgaaaacagcacggcgacgggtacggactcggccgcatccggtacgaatagcacggccaacggcacgaactcgaccgcgtcgggcgataacagcacggcgagcgggacgaatgcgtcggcgaccggtgagaacagcacggcgacgggtacggcttcgaccgcgtcgggcagcaacagcacggccaacggtgcgaactcgacggcatccggcgcgggggcgacggcaacgggtgaaaacgccgcagccacgggcgcgggcgcgacggcgaccggcaacaacgcatcggcatcgggcacgagcagcacggccggcggtgcgaatgcaatcgcgtcgggcgagaacagcacggccaacggcgcgaactcgaccgcatccggcaacggcagctcggcgttcggcgagagcgcggcggcagccggcgacggcagcacggcgctgggttcaaacgctgtcgcgtcgggtgtcggcagcgtcgcgacgggcgcgggttcggtcgcgtccggcgcgaacagttcggcgtacggtacgggctcgaacgcgacgggcgcgggcagcgtcgccatcggtcagggcgcgacggcctcgggatcgaactcggtcgcgcttggcaccggttctgtcgcgtcggaggacaacacggtatcggtcggctccgcaggcagcgagcgcaggatcaccaacgtcgccgccggcgtcaatgccaccgacgccgtcaacgtcggccagttgaacagcgccgtgtcgggcatccggaatcagatggacggcatgcaaggccagatcgatacgcttgcacgcgatgcgtattccggtatcgcggccgcgaccgcgttgacgatgattccggacgtggatccgggcaagacgctggccgtgggcatcggcacggccaatttcaagggctaccaagcctccgcgctcggcgcgaccgcacgtatcacccagaacctcaaggtgaagacgggcgtgagctacagcggcagcaactacgtgtggggcgcgggcatgtcgtatcaatggtaa

SEQ ID NO: 1046 - DNA, 9690 bp, Burkholderia pseudomallei
atgaatacgaagatgttgctgataagagccggtaaggttacgcccacgacactgaagacactcgccgtcgcaggagtggatagcggcgatgagatcgtgttttccagcttgccggccaattcggagttgaagcgcgacggcgcggatcttgtggtgcgcacgcccgacgagacgttcgtgctcaaggatgcggcggcgaagctggccgatgagagcgtggtggtgcgattgggcgaacagccgcttgtcgtcacgcaggcacccaatgaaaacactcatttgccggcgggcgtccaattggcaggcttggccgcgcccggccagaacagtgcgttcgggctgcaatcgttcgtgagcgccgccggcgagcagtcactgcagagcgatacggtgtcaccggtcgccatgggcgcggtgacgacatcgggcatcaaggacgcgggcctgagcgacggcgggctaatgggcaacctgcgaacggacgtgcggccgacggacgagatacccatgtatcagcagaagctgacgcagttgccgctcgatccgcgtatcgatgtgccgagccgcaccgacttcggcgtcaacgccgcgcgctatgagccggcaccggcggcggtgactgcgccgaatttcgtcatgtcgccgggggacaaggatccgggcgcgggcgtgttgcagaatgtcacgaatccgcaacttgacggcagcggtccggccaacgcggtcgtgaccgcgtacgaggttgcgtcggatggccatttgatctcgctcggcaccgcgacctcggacggtacggggaattttgcgatcacgcctaatacgccgctggcggacggtacgcacgacatcgtgttccaggcgcaaaaaggcgacctgacgagcccgttttccgcgccgaccagcgtcgtgatcgacacgaagatcaacacgccgacgatcggtcttcccgcgtcgtcggacagcttcggcgccggcacggtcggcacgaaccatgacgacatcaccaatgtcacgaacccgacgttgacgggcacggccgaagcgggagcgacggtatatgtgtccgacgggagcggccataccgtctcgacgattgccgacagtaacggcaactattcggttcaggcgccgggcacgctcgccgagggcaacaacgtcttcaccgtgcaggcggtggacaaggccggcaatacgagcggcaccgcacagcagaacgtgacgctcgacacggtggccgcgactctgccggcaccgcagttggaccacggctcggataccggcgcgtccaatagtgacggcatcacgcgcgccacccagccggtgttgacgggcggcggcgcggaaccgaatgcattggtgacggtatacgccgacggggtgtccatcggtcaggcgacggcggactcgctcggccattacacgatccactccggggtactggccgatggcacgcaccagatcacggctcgccagatcgacatcgccggcaacacgtcggcgttgagtggcgcggcgctcgtgacgatcgacacgagcgagccggcgccggcgaacctgaaactggtggacgatacgttcggtctgcatacagccggtacgccgagcgacggcctgaccaaggacagccgggtcacgatcagcgggacggcgagcgcgggtgacgtggtgacgctgatggacggcgcgacgtcggtggggcaggtcacggccgacgcaagcggcaactggacgatccagaccgcgtcgcttgccgacggcacgcatagcctgacggcgagcgcggtcgatctggcaggcaacacgagcccggcgtcgagcacgctgccggtgaccgtggatacgatcaacccgccgcctgcgctgacgctgtcgccgttgtcggacacgttcggctcgggcacatcgggcacgaaccatgacaacatcacgtcggcgacgctgccgacgttcaacggcacggcggcagcgggctcgtacgtgcagttgtatgacgtgacgggcggcacgaccgtgtcggtgggttcggcggtggcggacagcagcggcggttggacgacgacgttgacgagcccgctgtcgggttcggcgagcggcgtatcgcacacgttggtggcggtgggggtggaccctgcgggcaatacctcgacggtatccggtccggacgtggtggtgatcgacaatgcggcggccgtgctgcccggaccgacgatggcatccgcatcggatacgggcgcgtccagcagcgacggcatcaccagcaacacggccccggtgtttacgggcacgggcgcggaagcgggcgcgctggtgacgatctatgcgaatggcacgtcggtgggccatgcgacggccgacgccagcgggaactatacgattcagtccaacgcgctcggcgcggacggacggtatcagatcacggcgcagcaggtcgatatcgcgggcaatacgtcgccctcgagtagcgtgactgcgatgacgctggatacgagcgaaccggcgcccgtcaatctgcatctggtggacgacacgttcggccagggcacggccgggacatccagcgacaatctgaccaaggacagccgggtcacgatcagcgggacggcgagcgcaggcgacgtggtgacgctgatggacggcgcgacgtcggtggggcaagtcacggccgacgcaagcggcaactggacgatccagaccgcgtcgcttgccgacggcacgcatagcctgacggcgagcgcggtcgatctggcaggcaacacgagcccggcgtcgagcacgctgccggtgaccgtggatacgatcaacccgccgccagcgctgacgctgtcgccgttgtcggacacgttcggctcgggcacatcgggcacgaaccatgacaacatcacgtcggcgacgctgccgacgttcaacggcacggcggcagcgggctcgtacgtgcagttgtatgacgtgacgggcggcacgaccgtgtcgatgggttcggcggtggcggacagcagcggcggttggacgacgacgttgacgagcccgctgtcgggttcggcgagcggcgtatcgcacacgctggtggcggtgggggtggaccccgcgggcaatacctcgacggtatccggtccggacgtggtggtgatcgacaatgcggcggccgcgctgcccggcccgacgatggcatccgcatcggatacgggtgcgtccagcagcgacggcatcaccagcaacacggccccggtgtttacgggcacgggcgcggaagcgggcgcgctggtgacgatctatgcgaatggcacgtcggtgggccatgcgacggccgacgccagcgggaactatacgattcagtccaacgcgctcggcgcggacggacggtatcagatcacggcgcagcaggtcgatatcgcgggcaatacgtcgccctcgagcagcgtgactgcgatgacgctggatacgagcgaaccggcgcccgtcaatctgcatctggtggacgacacgttcggccagggcacggccgggacatccagcgacaatctgaccaaggacagccgggtcacgatcagcgggacggcgagcgcaggcgacgtggtgacgctgatggacggcgcgacgtcggtggggcaggtcacggccgacgcaagcggcaactggacgatccagaccgcgtcgcttgccgacggcacgcatagcctgacggcgagcgcggtcgatctggcaggcaacacgagcccggcgtcgagcacgctgccggtgcgggtcgacactacgacgacgctcccttcgctgacgctgtcatcgtcgtccgatacgttcggcgccggcacgtccggcacaaaccatgacaacatcacgtcggcgacgcagccgaccatcaacggcacggcagaggcgggctcgtacgtgcagctgtatgacgtgacgggcggcacgaccgtgtcggtgggtgaagcggtggccggcagcaatggcacgtggacgacgcaactggtgagcccgctgtcgggttcggcgagcggcgtatcgcacacgctggtggcggtgggggtggaccccgcggggaacacctcggcggtatccggtccggatgtgcttgtgatcgacacgtcgacgccatcgccgagcacgccggcgttgacgcctgctgatcagttcaacggcaatccgtcgacgacgctcaatgccagaccgacgctgactggcacggcagaggcaggcgcgagtgtcagcctgaccgatagcggcgtggtggtgggggtcggcgttgcggattcgaccggccattggacgatccagacgagtgcgctgtttgcgggcgggcacaccatcacggccacagccgtcgatatcgccgggaacagcaacgtctcgggttcgagcacgatcgcggtggctgcgaacgtcccgacgccgcctgcgccggtgctgatcacgccggatgatacgtcgccgatcgacagcaccaacaacgacgatctgacgcgcgtcaccatgccgcatttcacgggcacgacgaatcagggctatttagtgaccctgttcgtcgacggcgtgtccgtcgggcagggcgtagccggtggcaacggaagctggacgatccaggacggcacgtcgctggctgacggcgcgcaccaggtgacggtgcgcgtcagcgatccgttgacgggcgcgacaagcgcgatgggccccgggacgacggtgacgatcgacaccacgccgccggctgcgcccgtcgtgcagctcgcttcgtattcggacagcttcggtggcgggacgaccggcaccaacagcgaccacctgaccaacgtcacgcagccggtgctgaccggcacggccgacccaaacaccgtcgaattgctgctagaagggaccgtgacccttggcacggcgaccacgaatgcgtcgggtgcatggagcttcacgatccagaatccgctcgcggacggcacgcatacgttcgcggtcacgtcctacgaccaggccaacaaccattccgccgccaccaacctcgtcgtgacggtggacaccgtggcgcccgcggggacgacgccgaccctggacccgacgtccgattcgttctcgccgatcaacggcatcggcaataaccacgacaacatcaccaacaatctgtcaccggtcttcaccggggtgaaccaggttgcaggcggcgaggtgctgctctatgacaacgggcaactgatcggatcggccacgtcgctgggtgcggtgggaacgacctggacggtcagtcccggcaacctgtatccgggaacgcacttcatccagtcacgctatatcgaccccgccggcaataccggagcgttgtcgtcgggcgtgagcgtgaccatcgacaacagcgagcccgcgccgaccaatctgaacctgccggcgtcggcggactcggggcaaagcaataccgaccacatcaccaacgtgaccatgccgcccatcacggggaacgccaattaccaggatgtggtggttctgacggccgtcaacggcacgaccaccacgacggtaggcaccgcgacggtcggcgcgtcgggaagctggtcgatcgtgccgggctcgctcgcggacggcacgtatacgttctcggcggtggccgtggacgtggcaggcaataccagcaacccgggcgtgccggtccaggtggtggtcgatacgcacgcggcggcgccgtcgatcacgctgggtacgccgtacgatacgttcggcacgggcacgagcggcaccaactcggatgagttgaccaggaacaccatcccatacatgtacggcgtcgcagaaccgggcgcgcgcgtgaccgtcgtcgagaatggcaacaccatcggcacggtcaacgcggactcgagcacgggttcgtattcgatccagataccgccggcgacggtggacggcacctatacgttccaggcgatgcaggtcgacgtggcgggcaatacctcggcgtatagcgcgccgaactacgtgaccatcgataccgtggcggcgacgccgacgctgaccgcgctcacgcccgcatcggatacgttcggcgtgggcacggcgggcaataaccacgataacctgaccaacgcgtcgaccatcggcatcatgggcacggccgcggaagccggtgcggcgcttgatctataccagatcacggtgtcgggttccatcacgacgtcgacgtcggtcgcgcataccacggcgggcgcgggcggctcgtataccttcgcgtctttcacggcacctggggccgacggcgtctatacgtatgagacccgggaaatcgatcctgcgggaaacacgtcgccgatgtcgccggcattcaacgtcacgatcgaccgcacggtcgtggccccggtcctcacgctgcagaacgacacgcaatattcgggcagcccgaactggagcaccggcaccaatagcggtggcgcaggttcggccaacttcggcacgaccacggacgggctgacgaaagcgacgcaaccgatcgtgtccggaaccgtggaaaacggctcgctcgtcgtcgtctatcgcgacggcgtgtcgatcgggcagacgacggctaacagcgcgggtgcatggtcctttacggatccggtttcgcaggcagacggcacgcatgcgtatgcggcttatcaggtcgatcgggccggcaatacgtcgggcctcggcgccaacctggcggtgaccgtcgatacgcagatcgaaaccgcgcgctacctgcctgccccgacgccggcgggcgcgagtccgaactactacgcgcagatcggcattccggcgctggcgaacggcctgaacgcgcaggagatctacaacgtggatgcggcgggccacacgggcgtgccggtgtacttccagatcgatccggccacggccgccaaaggcaaggccggcgatatcgtggtggtggacttcacgttcacgtatgccaacggcacgggcaccgcgaccgtaacgacggaagcgtcctacacgattcaggcgcaggatctggtggtcacggccggcaacacgccgacgctgacgacgtgggtcacgcccaacacgttcttcgccggcaacaactggttgagcaactacaccggcgtcaatcagatgacggtgcaactgcaggtgcgcgatcaggccggcaatgtcggcttcaccaacacgccgaacgtcgacacgatcaacggcgcgatgaacgcctcgcacgtgaacatcgacctgtggacgctggcgaccaacaccggcaccaatacgtggctcggcaacggcgtgcaggtctaccgcgaacttggacgcccggctgatcagctgggctggcaggtcatcgtcggcgacgatttcaacaacgacgggatccacgacctgttcatgtacgcgccgacgggcggcgccgccaacaacaacggccggatgtatctggtggccggccaggcggacaccgttgcgaacggcacggggttcgtggatctgcagaacgtcggaaccacgtccgactggagcgagaaccacggtcaaggcgctgccaccggcggctatgtctggaccggcgtgggcaatcagagttacacgaactggacttccgttgcggacatcacgggagacggccgcggcgaactggcgttcgatcagaccgtggggccattttcgcaaggtaatccggagatcgttgcgaacattctgtacagcgatgcggtcggcccgggcggcttccagcaagcgctgacggggctgacgcggcccgagatgacgcagttctacgttccggttcacggcgattcagcctataccagccgaggggtgtcgtcgaacttcgccgccgagttcggcgcgcttgcgacgcattacgacttcaacggcgacggccgtggagacctcctgtgggcggacggcggcacgggcaacatgggaaacagcacgaccgtctacggtagtgtcttggtgggcttcacgccgagttcggccgtggggctgtacgacttgaggctgcccggttcgtcgatgaaccagacggcgagcaagggtttcgatgtctacagcactgacccgctgcacccggtgggggcgaattccgccctcacgcaggcgcccaacaacgtctgggcgcagccgatcggagatctgaccggcgacgggctgaacgacatcatcgtgggccagccgaacggcacgttcaacaatctcgcgaccaacggccgcgtggcggtcatcttcggccgcaacgacggccagggcgtcgacatcaacaatctctccgccggccagggcttctatatcacctggaacagcgcggtcaatgcgggcgacgtattcggtcagcagatcaaggtgatggatctgaacagcgacggttacgacgacgttgcgatctcgatccgttgttccgccgcgccgaacacgagcagcaacgattcgttcgatttcgtgatcgacggcaagtggctggcgaactacgtgcacaccaacctggccgcggggggcgccgtgccgacgctgagcatcgacgcgatctacaacgcgatggtcaatcacacggccacgccgatgggctggatcgacggcgacccgaccaatacgaacttcgcgggcaataccagctatccgctcaacgtgggtacgccggtgctgaagacagacctgaacggcgatggctaccaggacaccgtgatccggaacggcacgcagtattacgtgttgtggggtagccccgactatcacgcaggaacggatacgaactacggcaccacgttcttcaatcagccgaatcacctgtcattgctgaacaacaacgtgggcggcgcgccggtccagttcgccgacatcaacggcgacggcctgtgggacatgatgatctcgcaaccaggtaacgcgacggacggaacgaatggcggcctggtcgaagtggtgtatggcgtcaatagtcagtcgggctccgcgccaggctcgccgctgccgttcgcgtccagctacaccaatagctggacggcgggcgccgacacggtgacgggctcgagcggccgcgacatgctcaacgggggcgcaggcaacgacacgattgtcggcaacggcggcgtggacgtgctcgagggcggcggcggcaacgacatgctcgtggtcaacggcgacaacatcgcgcacttcacgacgccgggttcgtactgggacggcggcatcatgatgggcggtgaaatcaacacgctgcagttcgacgccaacaacacggccaacgcgacgctggatctcacgcaggtgagcgtgggcaacaacctgtcggcacaccttcacaatatcgagcgcttcgatctgaacggcaacggcaacatgctcaaattcgatcttcgaagcgttctggatacctcggcaatgggcgtattcctggacggcgggtcgagcggcgaaacctggtcgggttcgacctgggatccgggctatacgggctcgcacggcaaccgcacgacgccgttgggtccgaacgttccgatgaaacaatgggtgatcgacggcaatgcgaccaacacgctggatttcgagccgttcactcaaatggctcaaaccggcgccagcacgggcctgaccggcaattgggcccttgtcgggcacgtgacgcacaacgacgtgcacggtgtctcgcagaactacgacatttacgagttcagtggccagaacgcgcagatcatcgtgaaccacaacatccatctgacccacgcaggttcgggcacgacgctgtaa

SEQ ID NO: 1047 - DNA, 4821 bp, Burkholderia pseudomallei
ttgtcgtccattgcgctggcggcgtgcatattgatcgggagccttgggtccacgctgccggctgtggctggtacggtaataggcggcggggctcaataccccaattcggtaggcggaacgagttctacgaccggcgatttgggcaacagctatattggtgcgagcggtatgggtaccgccattactggggataatgattgcctgagcttgacttcgacccgcaacgtgctaaacagtgcgaatgtcggctggcttttgggaacgacttcacagaccaccgatcctggtccgttgtaccccggccccggcgcggaaaacaaccagactatcagttacagtggcacctccaatttttcgggtggtggaaatagcgcggctggtgcccaggcgaccctcgcctggggcttcaattccttcgcagcggggtgtgggaacaaatcgcttggcatgggttcgagtacgctcgggctcaataacatggccagcttggccggttcaactgcgatcgggatcgctaataccgcgtcaggagcgggcggaaccgcgatcggtctctacaacactgccgctggcacgggcagcgttgcaatgggcattggctctcaagcgacaggcaatggaacgatcgcactcggatacggcggcggcggcacctcgagcaacgccacattggcgagcggcagcaatgcgatcgcgataggcggagacgcgaccaaaggcgcgcaggcgacgggaagcgattcgatcgccatgggcagcgaggcggccgccagcagttccagcacgaccgcaatcgggcaatatgccaccgctagcaatacgaatgccacggcgctcggcgcgggcggaacatccgccgccactggcgtaatcgcaagcggtgcgggcgccgtcgcgctcggtggcaacagtacgcaaggcgcgcaggcgttggcaagcaacgccattgcgatcggcggccaatcgcaagccgctagcgccggtgcgatcgcgatcggccagagcgcactggccacgggtgggcaagcggtgtccgtcggcgtgggcaataccgcgaacggcaatggcgcggtggcgatcggcgatccgaacgtcgcgaccggcacgggagcggtggcgctgggggcgaacaataccgccaccggacaaggcgcggttgcgctcggcaacgctgatattgccacgggccaaggttcggttgcgctcggtaatgtgtcgacggccgccggtgcaggatcggtggccttcggctcgaatgccgtagccaacaacacgaacgatgtggcgctgggctccggatctgtgacagccgcgccgaatccgacggggagtgcgacgatcggcggaaccacatattcgtttgagggaaccaatccgacgagcgttgtgagcgtgggcgcagtgggcgcggaacgccagatcacgaacgtcgcggcgggacaactgacggcgacgagcacggacgcagtcaacggttcgcaactttactcgacgaatcaggcgattaatacattatcgacgtcgacttcgacgggcctgtcgtcggcgaatagctcgatcgcgtcgttatccactggcctcgcatcgtccggcaacctggcttcgctgtcgacgtccacgtcgacaggcctgtcatcggcgaatagctcgatcgcgtcgctgtcgacgtcgacttcaacgggcctctcgacgaccaacagcaacatcggctcgctgtcgacaggccttagcacgactaatagcacggtcgcatcgttatcgacgtccacgtcgacgggattgtcgtcggcgaccagctcgatcacgtcgttgtcgacgtcgacctcgagcggcatcagtaccgctcagagcggcgtcaattcgctgtcgactggcctgtcgaccaccaacagcgcagtcacctcgttatcgacgtccacgtcgacgggattatcgtcggcgaccagctcgatcacgtcgttgtctacgtcgacgtcaactggaatcggctcgctgtcgaccggtctgagcacgaccgacagttccgtaacgtcgctgtcgacgtcgacctcgagcggcatcagtaccgctcagagcggcgtcaattcgctgtcgactggcctgtcgaccaccaacagcacggtcacctcgttatcgacgtccgcgtcgacgggattatcgtcggcgaacagctcgatcacgtcgttgtcgacgtcgacctcgactggattgagctcgttgtcgacgggaatcgcgaattccgttcagtatgacaacaccagccatactcaagtcacgttgggaggagccggcgcgacgacgccggtgacgctgaccaatgtcgccgcgggcgtgaatcccaccgatgcggtgaatatgagtcagctgacttcgctgtcgacgtcaacgtcaacgggactgtcgacgaccaacagcaacattggctcgctgtcgaccgctctgagcacgaccgacagttccgtgacgtcgctgtcgacgtcgacctcgagcggcatcagtactgctcagagcggtgtcaattcgctgtcgactggcctgtcgaccaccaacagcacggtcgcatcgctatcgacgtccacgtcgacgggattgtcgtcggcgaccagctcgatcacgtcgttgtctacgtcgacgtcaactggaatcggctcgctgtcgaccggtctgagcacggccaacagttccgtgacgtcgctgtcgacgtcgacctcgagcggcatcagtaccgctcagagcggcgtcaattcgctgtcgactggcctgtcgaccaccaacagcacggtcgcatcgctatcgacgtccacgtcgacgggattgtcgtcggcgaccagctcgatcacgtcgttgtctacgtcgacgtcaactggaatcggctcgctgtcgaccggtctgagcacggccaacagttccgtgacgtcgctgtcgacgtcgacctcgagcggcatcagtaccgctcagagcggcgtcaattcgctgtcgactggcctgtcgaccaccaacagcgcagtcacttcgttgtcgacgtccacgtcgacggggctgagctcgctgtccacgggtctgtccgcgaccaacagcaacatcagttcgctgtcgacttcgacctcgaacggcctgagcacagctaacagcaatatctcgtcgctgtccactgggctgagttcgctgtcgaccgcagtcaacggcggcgggaccaagtactttcacgccaactcggcgcagccggacagtcaggcgctggggacgaacgcgatcgccgtcggaccggcggccacggcatccggcgcaagcggtatcgcgatcggcgataccgcgaacgcggctgcaactggcgcggtggcgattggccagaccgccgttgcaacgggtggtcaggcggtctcgatcggtgttgcgaatacggcgagcggcgacggcgcggtcgcgatcggtgatccgaacgtcgcgacgggtactggtgcggtcgcgctgggcgcgaacaattctgcgaacggccagggcgccgttgcgctcggcaatgcgaacgtggcaaccgggacaggctcgctggcgctcggcagcacatcgacggcggcggggggcggctcgatcgcgttgggcacgaatgcaatcgcgaacaatgccaacgatgtcgcgctgggttccggtagcgtaaccgcagccgcgaatccggtcgccagtgcgctgatcgccggtcagacgtattcgctcgccggcggttcaccgacaagcgtggtgagtgtcggtgcgccgggtgcagaacgacaaatcaccaacgtcgcggcagggcaggtttccgccacgtcgaccgacgcggtgaacggatcgcagatgaacgccgtgacccaagcgctggtatcgttgtcgacttcgacagccaatgcgttgtcgacgacgcaaaacggtctgagttcgttgtcgacagggctgagcacgacgcagagcagtgtgagttcgctgtcgacgggccttagcacgacgagcggtaacgtgtcgtcgctgtcgaccggcttgagtacgacgcagagcgatgtcgcgtcgctgtcaacgggactgagtacgacgaacagcaatctcgcgtcgttgtcgactgcggtgtccaacggagggattcacaccaacggcgcgggcggcacgtcgatggggccgggagccgacgcgtcgggcagcaacagcacggcggtcggtggcgcagcgtctgcttcgggagccaatgcaacggcgctcggccaggcgtcgaacgcatcgggcaataattcgacggcattagggcaagcatcgagtgcatccggaagcggctccaccgcggtggggcagggcgcgagcgcgtcgggcgatgggtcctcggcattcggccaaggggcgattgcctccggcacgaactcgacggcgctgggcgctcattcgacggcatcggcgccgaattcagtggcgatcggcgcgaactcggtagcttccgcgccgaacacggtgtcgttcgggtctcagggccatgagcgtcgactgacgaacgtcgcaccggggatggacggtaccgacgcagcgaacatgagccagctttggggcgtgcaatcgagcgtagaccaagccgcgcgccgtgcgtattcgggtgtggcggctgccaccgcgctgacgatgattccggaagtcgatcctggcaagacgattgcagttgggatcggtgccggcagctatcaagggtattcggcatccgcgatcggtgtgtccgtgcggttctccgacaacctgaaggcgaagctcggcatggggatcagcagtcagggcagcacgtacggcggaggcatctcgtaccagtggtaa

SEQ ID NO: 1048 - DNA, 192 bp, Burkholderia pseudomallei
atgctgcgtttcatccaatcgctttggcgcgacgagcgcggggtcagtgcgctcgaatattcggtgctggccggcatcgtggtggtggcggtcgctgcagcgggcgccattttcggcggcggctccggcttgccggaattgttccagaacatgatcaccaaggtgacgagcgtacagaccaacggccattga

SEQ ID NO: 1049 - DNA, 396 bp, Burkholderia pseudomallei
atgacgacgcatgacctcacccagactgccgcgccccgcgccgggcgcggccgcgcgctgtgcgcggccgcgctcgcgctcgcgcttgcgtgcgcggtgggcgccgcccgcgcgcaatcgccgcagcgcgacgcgccgagcgcatcggaaatcggccacgcgacgcagacgtggttcgcgctgcaggcgagcaaccgggaggcggcgccggcgcagccgatgatcggcgaggcggcgtcgctcgcgtacgcgcgctatatcgagtcgttcaggacgaagatcccggccttctacggatcggccgcgggcatgagcggtatgagcggcgggggcggcgggggcggcgggggcggcggcgcgggctattccctcgcgccggcatcgggttcgcagtga

SEQ ID NO: 1050 - DNA, 138 bp, Burkholderia pseudomallei
atgtggaacgaaaaaaggttcggatataagatgcgctcgtgcgctatttgtacgacctggtacatcagggaatacgaggaggacgccgccgacatgaatgttaacttgtatcaaattgttaaaaactctcgaaaatag

SEQ ID NO: 1051 - DNA, 1497 bp, Burkholderia pseudomallei
atgaaaaccttcccgttgtccgcttgccggaccgccgtggccgtcgcggtcgccgcgctcgcgctcgcgggatgcgcgaactatttcggcctcaagagcgacaaggcgatcgctcccgcggcgcagttcgaaagcgcgcggagcctgcccgcgcagggcggccaatggccgtcgctcgactgggcgaaccagttcggcgatccgcaattgccgaagctgatcgacgaggcgctcgaaggcaatccgacgatcgcgcaggcgcaggcgcgcatcgcgaaggcgtcgtcgtacatcgagtcgtcgcgctcgacgctgctgccgaaggccgacgcgaagtactcgtggacccgcgagctgtactcgggcaacgcccttttcccgcccccgtacggcggccagtggtacagcgagaacaacgcgctcgcgagcgcgtcgtgggagctcgatctgtggggcaagaaccgcgcgcgcctgaatgcggccgtgtcgcaggaaaaggccgccgaagccgacctgcagcaggcgcgcgtgacgctcgcgacgtcggtcgcgcgcacgtacaaccagctcgcgcaactgtacgcgctgcgcgacatcgccgggcgcgagatctcgaaccggcagacggtcggcaagatcaccgacggccgcgtcggcgcgggcctcgacacgaacgtcgagcgccagaccgcgcgcggcaacatcgcgacgagccagtcgacgctgtccgatctcgacggccagatcacgaacgtccgctatcagctcgccgcgctgctcggcaaaggtccggaccgcgggctgcagatcgccgcgcccgtgctgagcgcgggcggcgcggtcgcgctgccggagaacctgcccgccgatctcgtgtcgcgccgcccggatctcgtcgccgcgcgctggcaggtcgaagcggcgatgcacgacgtgaaggaagcgaaagccgagttctttccggacatcaacctcgcggcgggcttcggcttcgacgcgttcggctggggccgattcctgaacttcgcgagccgccaggcgcagttcggccccgcgatccacctgccgatcttcgacggcggcgcgctgcgcgcgcaattgaagggccgctacgcggacttcgatctgtcggtcgcgaactacaaccagacgctcatcaacgcgctgaacgacgtcgcgacgcaagtcgcgtcgattcgctcggtcgacacgcaaatgggcgacgcgcagcgcgcgctcgatgcgtcgacgcgcgcctacgagctcgcggtgatccgctacaaggcgggcctgtcgccgcagttgcaggtgctcaacgcggacagcaaccggctcgccgccgagcagacggtgacgaacctgaagatgcgccgccgcgacctgcagatcggcctcgtgaaggcgctcggcggcggcttcgacgcggccggcacgcggctcgccgcgcccgcccccgcctcggcgccggccgcgcccgcgcagcacgcatcgaactga

SEQ ID NO: 1052 - DNA, 225 bp, Burkholderia pseudomallei
gtggtcgtttcgctggcactcgcccctccctcgcgcgccgaccaattttctccccggcagcacgctcagcgggaacagttcgcccgctcgcaagcgaatgcggctgcgcccgccgatgcgcgccccaatgtgccgcgcggcaatctgcgcggcgacatcgccagcaacgcgcgtgcgcgcaacaacgacgcgcaacgcccgcccggcgactcgaaccatcactga

SEQ ID NO: 1053 - DNA, 705 bp, Burkholderia pseudomallei
atgaacaaagtctacccaagcgcggctgccgcgctcgagggcgtcgtccatgacgggcagaccttcgcggtcggcggcttcggcctgtgcggcattccggaagcgctcatcgccgcgctgcgcgattcggcggtgaagggcatcacctgcatcagcaacaacgcgggcgttgacggcttcggccttggcctgctgctcgaaacccggcaaatcaagaagatgatctcgtcgtacgtcggcgagaacaaggagttcgaacgccagtatctgtcgggcgaactcgagctcgagttcacgccgcagggcacgctcgcggagaagctgcgcgcgggcggcgcgggcatcccggcgttcttcacgcagacgggctacggcaccgtgatcgccgaaggcaaggagacgcgcgagttcgacggcaagcattacgtgctcgagccgtcgctcacggcggacgtcgcgctcgtgaaggcttggaaagccgacaagtcgggcaacctggtttaccggcgcaccgcgcgcaacttcaatccgatgtgcgcgatggcgggccggatcacgatcgccgaggtcgaggagatcgtcgagaacggcgagctcgatccggatgcgatccacacgcccggcattttcgtgcagcggctcgtgctcaacgcgacgccggaaaaacgcatcgaacaacgcgtcgtgcgcgcgaaaggagactga

SEQ ID NO: 1054 - DNA, 2049 bp, Burkholderia pseudomallei
atgcgcaagaaaagcttggttcatttgcccgtcgcgctggcggtggccgcggcgctcggcgcgtgctcgggcgacgacgacgcgacgctcgagtcgcgcgcggacgcgatcgtcgaacgcatgacgacccggcagaaggtcggccaaaaactgatgatggcgttccggtactggtgccccgacgggcagcccgcgtgcacgaccggcatgaccgaatttccggacgccgcgcgcgacgcgctgcgcgagaacggcattggcggcgtgatcctgttctcgaacaacctgacgggcatcgagcagacgcgccggctgatcgacggcattcgggccgcgcccgcggccgacagcccgctcgggctgatgatcggcatcgacgaggagggcggcaacgtgtttcgcctgccgcgcgtcgaggcgaccgcgttcgccggcaacatggcgctcggcgcggcgtacgaagcgacgcgggacgaccggctcgcgtacgacatgggccgcgtgctcgccgcggagatcgcggcggtcggcttcaacgtgaatttcgcgccggacgtcgacgtcaacagcaatccgctcaatccggtgatcaacgtgcgcgcgttcggcgacgatccggcgacgatcggcctgctcggccggcgcatggtgcagggcatgaagagcgagcgcgtgatcggcacgttcaagcattttcccgggcacggcgacacggataccgattcgcactacggactgcccgtcgtgatcaagtcgcgcgccgacgcctacgcgatcgatctcgcgccgtaccggcaggcgatcgaagcgggcgaggcgcccgacatgatcatgaccgcgcacatccagtatccgtcgctcgacgacacccgcgtcgcgacccgcacgggcgagcagatgatcgcgcccgcgacgatgtcgcggcgcatccagcacgatatcctgcgcggcgagttcggctatcagggcgtgacgatcaccgacgcgctcgacatgaagggcatcgccggcttcttcgacgaggacgacgcggtcgtcaaggtgttccaggcggacgtcgacattgcgctgatgcccgtcgagtttcgcaccgcggccgatgccgggcgcctggcggcgctcgtcgatcgcgtcgccgcggcggtcgattcggggcggatcgatcgcgccgagttcgatcgctcggtgcgccgtatcgtgctgacgaagctgcgccacggcatcgtcgcgtcggatcgcggccggccggtcgacgagctggcatcgatcggcgggcccgcgcaccgcgcgatcgagcgcgacatcgcgcaaaaatcgatcaccgtgctgcgcaacgagaacggcgcgctgccgctgcaggccgcgggccggcgcatcttcatcctgacgccgtggggcgagcaggccgaggcgatgcggcggcgtttcgtcgagcttggccatccgctcgtcacgggcgcgaagctgagcacgatcacgtgggccgaacagcagcaggcgatcgatgcggccgacgtcgtgatcgtcggcacgctgtcgacgggcgtcacgcccgtcgagcacaacggggatccgaacgcgcgcgtgagcccgccggcgccgtcggccgtgcggatgcggcaggccgcgcccgcgaacggcgaggaggagggttcggtgatcttcgaccacgtcgagcgggcggacgcggcgaaggacatcggcgcgcgcccgagcgtgctcgcggcgatcgcggcgccgagcgaggcgcagcagatgcgcgacgcgatggactacgcgaaggcgcggcgcaagaccgtgatccacgtgacgatgcgcgcgccgtacgacgtgatcagctacgacgatgtcgcggacgcgacgctcgccacctacgcgtactacggctacgaaggcggcttgcgcggcccgtcgctgcccgcggccgtcgacgcgatgctcggcgtcgcgcggccggtcggcaggctgccggtcgcgatccacgcactgaacgcggacggatcgacggggccgctgcgctacgcgcgcggattcgggttgcagtactga

SEQ ID NO: 1055 - DNA, 1386 bp, Burkholderia pseudomallei
ttgccgcgatacgcccgccagcaccgttcgttcttcgtcgcgccgcgcgcgttcgcggccgccgccgcgcttgccgcgggcgtcgccgcgtgtgacgcgaacgggccgggcgcgagcgccgccgcggccgtcgcgcccgctgcgctcgctgtcccagctgcctccgctgcgcgtcccgcgccgctcgcgcagccggccgcgcccgccatcgtcgacagtcagccgcagacgcgcgcgcaggtgtacgaggcggtcaagcagatgacggcgctcggcaggcagttgttcttcgatccttcgctgtcgggcagcggcaagctcgcctgcgcgtcgtgccacagcccgcagcacgcgttcgggccgccgaacgcgctgcccgcgcaattcggcggcgacgatctgcgccagcagggctttcgcgccgtgccgacgctcaaatacctgcagaaggtgcccgcgttcagcgagcactatcacgaatcggacgacgagggcgacgagagcgtcgacgccggcccgacgggcgggctcacgtgggacggccgcgtggacagcggcgccgagcaggcgcgcgcgccgctcacgtcgccgttcgagatgaacggcacgcccgagaaggtcgcgcgcgccgtgcgggccgcgccgtacgcgcccgcgtttcgcgcggcgttcggcgcgcgcgtgctcgacgacgaccgcgcgacgttcgaggcggtgctgcaggcgctcggcacgttcgagcaggcgcccgacgtgttctatccgtacacgagcaagtacgacgcgtacctggcgggccgcgcgcggttgacgcgcgccgagctgcacgggctgcaggtcttcaacgacgagaagaagggcaactgcgcgagctgccacgtgagccggcgcgggctcgacggctcgccgccgcagttcagcgatttcggcctgatcgcgctcggcgtgccgcgcaatcgcgcgctcgcggtgaatcggaatccgaatttttacgacctcggcgcatgcgggcccgagcgccgggacctgaaggggcgcgacgagttctgcgggctgttccgcacgccgacgctgcgtaacgtcgcgctgaagaagacgttcttccacaacggcgtctatcactcgctcgacgacgtgctgcgcttctacgccgagcgcgacacgcatccggagaagttctatccggtgaagcgcggcgtcgttcagaagttcgacgacttgccgaagcgttactggaagaacctgaacgacgagccgccgttcgagcgcaagcgcggcgatccgcccgcgatgaccgatgcggagatccgggacgtgatcgcgttcctcggcacgctcaccgacggctacgatccgcgcgcgaagccggcaggcggcgcgcgctga

SEQ ID NO: 1056 - DNA, 525 bp, Burkholderia pseudomallei
atgtcgaccttacaacgagtgcttttcctgctgggcgtcgcggcgtggccggctgccggccgggccgacacgctgctgccccgaacccaggccttcacggtcagcgcgcagatcgtcgcgggctgcggcgtcgcgggcggcgggccggcgagcggcctgaacttcggcacgctcgacttcggcgcgcatccggccgtcgcgacggggcaggtgagcgcggccgtcggcggcggcgcgttgcagatcgaatgttcgccgggctcgacgttgaagatgacgatcgacggcggcgcgaacgcgagcgcgggcaacacgcagcgcaatctggcgagcggcggcgcgcgcgtcgcataccggttgtattcggacccggcgcgcacgcaggcgatcgcggtcgggcaggcggtgtcgctgcccgtgtccggcacgatcacgctgccgatctacggcgcgctcacgctgccgggcggcggcgcgcccgccggcacgtataccgataccgcgcaggtcacgctcagttattaa

SEQ ID NO: 1057 - DNA, 546 bp, Burkholderia pseudomallei
atgcacaagcgtgaggtgcaggtggtgagcggggcggcattcatgctgtttttcgcggctgcctcggccgggcaactgaccggcacgatgcaggtgaatttgcaggtcagtcgcggatgcgaggtcgcgggtgtggccgcaagcggggacttgggccggctggatttcggcgcgcaagggccgctctggtccgactacctgacggccgacggccgcgccacgtcgagcggcgcggtgcgcgtcgtgtgcagtccggacgtcaacggctttctggtctcgatcgacggcggtcgcaacggggatcagtcgacccgctatctggtcaagcgcggcgcaaacgggcgcgtcgccggccggattccctacaacgtgtaccgcgacgcggcgcgcagcgtgccgtacgtgccgctcatgccgcagtcgttcctcgtcgacggggggcgggacgacgtgacgctgccggtgtacggcgtcgtcaacggcatgacgcgcgcggtgccgtccgggacctacgaggatttgctcggcatcacgctcgactggtga

SEQ ID NO: 1058 - DNA, 3273 bp, Burkholderia pseudomallei
atgaacaagacttatcgggttagctggagcgcgtcgcggggtgcgtggatggtggcgccggagacggcgcgtcgcaaagggaaaggacattcgctgacgatcgtgtgcgcgatcgcctcaggcctgctgcttgcggcgcctgcgtgggcggacacggtgtcgccctcgggcacggataacgtctacggcgtcgacgcgaccgatcccggcgtgtcgacgaaccagggcaatacggcctacggggcgcaggcgggcgcgaaggtcacgggttcgtacaacaccgcgatcgggtatcaagcagggcagaacgtgaacgccatcgataccgtatcgatcggcaagcaggccaccgcgagcgcgaatgacgcgatcgcgatcggcacgaacacgaaggcgagcgggccggccgacatctacatggggctgaacgcaggcgccggcgccggctcgacgacgagcccggacggcaccgtcacgctcggcattcgcaacatgggcctcggggaatccgcgggctcgtacgtgacgggccagaacaacacggggatcggctatcagtcgggcatgaacgtgacgggcgaccagaacgtcggcctcgggcagcaggcgggacaattcgtgaccgggaccggcaactcggcgatggggcatctggcggggtcgacggtgtcgggcagctacaacgccgcgttcggcgagtatgcggggaccaacacgagcggcggcgccaatgccgcgttcggcttctatgcggggcgctacatcaacggcacgaacaacacggcgctcggcgcgtacgatctgccggtcgtcaatggcacctggtacggttcgtacgtgacgggcagcaacaacctcggcgccggccataattcgggcgcctacgtgagcggcgcgagcaacgtcgggctcggcgacggcgcgggcacgttcgtgaccggcagcaacaacgtcgccatcggcacggcagcgggctcgggcgcgtataccagcggtccgagcggcgcgacgctcaatgcggcgctcgtcgcgagcaacaccgtgagcatcggtacccgcgccacggcgagccagagcgacgcgatcgcgatcggcaagggcgcgaccgcgagcggcgcgcaatcgatcagcatcggcaccggcaacgtcgtgagcggcaagggaagcggtgcgatcggcgatccgagcaccgtcagcggcgcggggtcctattcgatcggcaacaacaataccgtcgcgaacagcaacacgttcgtgctcggcaacggcgtgacgacgacgcaggacaacagcgtcgtgctcggcaatcagagcaccgaccgcgcggccgtcgcggtttcgagcgaaaccatcaatggcacgacgtacaactacgcgggcgtcgcgagcccggccaacggcgtcgtcagcatcggcggcgtgggcacggagcgccagctcatcaacgtggcggcgggccaggtgagcgcgaccagcacggacgcgatcaacggcagccagctgtacgcgacgaaccaggcggtgatcgccgaggacgcgaaagtgaattcgctcggcggcggcgtggcgagcgcgctcggcggcaacgcggcgtacaacgcgacgaccggcgcgatcaccgcgccgagctacgcggtctacgggaccacgcaaaactccgtgggcggcgcgatcgatgcgctgcaggccctcgcgccgctgcagtacacgtccggcccgggcgtgaccacgccgaacgcgccgggatcggcgccgacgaacacggtgacgctcgtcggcgccggcgggccgggagccaataccacgccggtgacgctcacgaacgtcgcgccgggcaaactctccgcgaccagcacggacgcggtcaacggctcgcagctctacgcgaccaaccagcaggtcgcgaacctcgtgagctcggtgaacaacggcggcgtcggcccggtgcagtacagcgatcctagcgcgccgacgacgcccaacggcggcaagccctcgcaggacctgacgctcgtcggcgcggcaagcggccctgtcgcgctgcataacgtcgcgccgggcacggcgtccaccgatgcggtcaacgtcgggcagctcggcgcggtgacgaccggcctgggcggcggcgcggcgatcgatccgaagacgggcgccgtgaccgcgccgtcgtacacggtctacaacgccgacggcacgacgtcgaacgtcggcaacgtcggcgcggcgatcgatgcgatcaactcgaccggcatcaagtatttccacgcgaacagcacgaagccggacagccaggcgctcggcgcggacagcgtcgcgatcggcccgaacgccgtcgcgaacaacgcgggcgacgtcgcgctcggttcgggagcggtcacgtcgcaagcgggcggcacgctgagcgaaacgatcaacggcgtgacctactcgttcgccggcacgacgccgatcggcacggtgagcgtcggcgcgccgggcgtcgagcgcacgatcaccaacgttgccgcggggcgcatcgggcagtcgagcacggacgcgatcaacggctcgcaactgtacggcaccaaccagtcgatcgaggcgttgacggacaagatgaacagcctcggcaacaccgtggcgaacacgctcggcagcggcgcgtcgtacaacccgcaaacaggcgcggtgaacggcccggccaactcgggcggcgtggtcacgcccacggtgatccaggaggcggcgaacaaatgggtgagcgccaatccgtcgacctacgtggcgcccgtcgcgacgggcacgaacggcatggcggtcggcagcggcgcggtttcgacgggccagaactcggtcgcgctcggcacgaacgcgtcggacggcggccgctcgaacgtcgtgagcgtcggggcgccgggcgcggagcgccaggtgacgaacgtggcggccggcacgcaggcgaccgatgcggtcaacctcgggcagatgaacggcgcgctcgcgcagcaaaccgacagcttcaaccagcggctgggcgcggttcagcaggacgtcgacaacgtcgcgcgcgccgcctacggcggcatcgcggccgcgaccgcgctcacgatgatccccgaggtcgacaaggacaagacgatcgcggtgggcatcggcggcggcacgtatcgcggctaccaggcggtggcgctcggcgcgacggcgcgcatcaccgagaacatcaaggttcgtgcgggcgtcggcatgagctcgggcgggacgacggccggcatcggcgcatcgatgcagtggtaa

SEQ ID NO: 1059 - DNA, 645 bp, Burkholderia pseudomallei
aaagggaaaggacattcgctgacgatcgtgtgcgcgatcgcctcaggcctgctgcttgcggcgcctgcgtgggcggacacggtgtcgccctcgggcacggataacgtctacggcgtcgacgcgaccgatcccggcgtgtcgacgaaccagggcaatacggcctacggggcgcaggcgggcgcgaaggtcacgggttcgtacaacaccgcgatcgggtatcaagcagggcagaacgtgaacgccatcgataccgtatcgatcggcaagcaggccaccgcgagcgcgaatgacgcgatcgcgatcggcacgaacacgaaggcgagcgggccggccgacatctacatggggctgaacgcaggcgccggcgccggctcgacgacgagcccggacggcaccgtcacgctcggcattcgcaacatgggcctcggggaatccgcgggctcgtacgtgacgggccagaacaacacggggatcggctatcagtcgggcatgaacgtgacgggcgaccagaacgtcggcctcgggcagcaggcgggacaattcgtgaccgggaccggcaactcggcgatggggcatctggcggggtcgacggtgtcgggcagctacaacgccgcgttcggcgagtatgcggggaccaacacgagc

SEQ ID NO: 1060 - DNA, 882 bp, Burkholderia pseudomallei
atggcggcaattaccgcaagcatggtggcagaactgcgcgcgaagaccgacgcaccgatgatggaatgcaagaaggcgctgacggaagccgacggcgacatggccaaggccgaagagctgctgcgcgtgaagctcggcaacaaggcgagcaaggccgcgtcgcgcgtgacggccgaaggcgtcgtcgcatcgttcgtcggcgcgaatgccggcgcgctcgtcgagctgaactgcgaaaccgatttcgtcgcgaagaacgacgatttcaatgcgttcgcgaagacggtcgcggagctcgtcgcgacgcagaacccggccgacgtcgccgcgctgtcggcgctgccgctcgacggcaagaccgtcgacgaagtgcgcctcgcgctcgtcggcaagatcggcgagaacatctcgatccgccgtttcgtgcgtttcgaaacgtcgaacaagctcgcgacgtacctgcacggcagccgcatcggcgtgatcgtcgagtacacgggcgcgcaagagcaggtcggcaaggatgtcgcgatgcacgtcgccgcgatgaagcccgtctcgctgtcggccgacgaagtgccggcggacctgatcgagaaggagcgccgcgtcgccgagcagaaggccgcggaatcgggcaagccggccgagatcgtcgcgaagatggtcgacggcagcgtccagaagttcctgaaggaagtgtcgctgctgaaccagccgttcgtgaagaacgacaagcagacgatcgagcagatgctcaaggccgcggatgcggcggtgcagaagttcgccctcttcgtggtcggcgaaggcatcgagaagcgccaggacgacttcgccgcggaagtggccgcgcaagtcgccgccgcgaagcagcagtaa

SEQ ID NO: 1061 - DNA, 1254 bp, Burkholderia pseudomallei
ttgaaactcccgtacgaatggcagatcggctggcgctacacgcgcgccggcaaacgcacgaccggcaacggcttcatttccttcatcgcgctcgtgtcgatgctcgggatcgcgctcggcgtcgcggcgctcatcgtcgtgctgtcggtgatgaacggcttccagaaagaggtgcgcgaccggatgctgtcggtgctcgcgcacgtcgagatcttctcgccgacgggctcgatgcccgactggcaactgaccgcgaaggaagcgcgcctgaaccgctcggtgatcggcgcggcgccgtatgtcgacgcgcaggcgctgctcacgcggcaggacgcggtgagcggcgtgatgctgcgcggcgtcgagccgtcgctcgagccgcaggtgtccgacatcggcaaggacatgaaggcgggcgcgctcaccgcgctcgcgcccggccagttcgggatcgtgctcggcaacgcgctcgcgggcaatctcggcgtgggcgtcggcgacaaggtcacgctcgtcgcgccggaaggcacgatcacgccggccgggatgatgccgcgcctgaagcagttcacggtggtcggcatcttcgagtccgggcactacgaatacgacagcacgcttgcgatgatcgacatccaggatgcgcaggcgctcttcaggctgcccgcgccgacgggcgtgcggctgcgcctcacggacatgcagaaggcgccgcaggtcgcgcgcgagctcgcgcacacgctgtcgggcgacctgtacatccgcgactggacgcagcagaacaagacgtggttctccgcggtgcagatcgagaagcggatgatgttcatcatcctcacgctgatcatcgcggtcgcggcgttcaatctcgtgtcgtcgctcgtgatgaccgtgacgaacaagcaggcggacatcgcgatcctgcgcacgctcggcgcgcagccgggctcgatcatgaagatcttcgtcgtgcagggcgtgacgatcggcttcgtcgggaccgcgacgggcgtcgcgctcggctgcctgatcgcgtggagcattccgtggctcattccgatgatcgagcatgcgttcggcgtgcagttcctgccgccgtcggtgtacttcatcagcgagctgccgtccgagctcgtcgcgggcgacgtgatcaagatcggcgtgatcgctttcgcgctgtccgcgctcgcgacgctctatccgagctggcgcggcgcgaaggtgcgcccggcggaggcgctgcgctatgaatga

SEQ ID NO: 1062 - DNA, 210 bp, Burkholderia pseudomallei
atgaaatggaccgattcccgcgagatcgcgatcgcgctcgcggaccagcatccggatgtcgatccgaagacgatccgctttaccgagctgcgccagtgggtgctcgatctcgacggcttcgacgacgatccggaccattcgggcgagaagattctcgaggcgatccaggcgcactggatcgacgaatcggatttcgacgacgaggattga

SEQ ID NO: 1063 - DNA, 570 bp, Burkholderia pseudomallei
atgtccttgctgacccccgagcaaatcgccgccgcccagaaagccaacatcgaaagcctcttcggcctcacgacgaaagcgttcgaaggcgtcgaaaagctgatcgaactgaatctgcaagtggtgaagtcgacgctcgccgaaagccaggaaaacgtgcagcgcgcactgtcggtgaaggatgcacaggaactgctcgcgctgcaggcgagcctcacgcagccgatcgccgagaaggtgctcgcgtacggccgtcacgtgtacgaaatcgcgtcggccacgcaagccgaattcgcgaaggtcgccgaggcgcaatacgaggaacagaaccgcaaggtgcaggcgctcgtcgacaacgtcgcgaagaacgcgccggccggctcggaaaccgctgtcgccgcgctgaagtcggcgatcaacgccgcgaacacgacgtacgaaacggtgcagaaagccgcgaagcaagcggtcgagatcgccgaaacgaacttcaacgccgccgccgccgtcgccacgaaggcggcgaacaccgcggccgccgcgtcgcgccgcagcggcaagacggcgtaa

SEQ ID NO: 1064 - DNA, 936 bp, Burkholderia pseudomallei
atgacgattctggtgattgcggaacacgacaacgcgtcgatcaaggcggccacgctgaacacggtggcggcggcgacgaagatcggcggcgacattcacgtgctggtggcgggccataacgcgcagggcgcggcggacgccgcggcgaagatcgcgggcgtgagcaaggtgctgctggccgatgcgccgcaactggcggacggtctcgcggaaaacgtcgaggcgaccgcgctgaacgtcgcgaaggactactcgcacatcctcgcgccggcgaccgcgtacggcaagaacatcgcgccgcggatcgcggcgaagctcgacgtcgcgcagatctcggacatcacggcagtcgattcggccgatacgttcgagcgcccgatttacgcgggcaacgcgatcgcgacggtgcagtcgagcgacccgatcaaggtgatcacggtgcgcgcgacgggcttcgacccggtcgcggcgcaaggcggcagcgcgtcggtcgagaagatcgacgcggcggcggacgcgggcgtgtcgcagttcgtgagccgcgaggtgacgaagctcgatcgtccggagctcacgagcgcgagcatcatcgtgtcgggcggccgcggcctcggcagcggcgagaactacacgaaggtgctggagccgctcgcggacaagctgcaggcggcgctgggcgcatcgcgcgcggcggtggacgcgggctacgtgccgaacgattatcaagtgggccagacgggcaagatcgtcgcgccgcagctgtatatcgcggtgggcatctcgggcgcgatccagcacttggcggggatgaaggattcgaaggtgatcgtcgcgatcaacaaggatccggaagcgccgatcttcagcgtggccgattacggcctcgtcggcgatctgttcacgctcgtgccggaactcgtgaacgagctcggctga

SEQ ID NO: 1065 - DNA, 843 bp, Burkholderia pseudomallei
gtgcgtaccgccgacgggctcgagctcgcgtgctaccgttggccgtctaccgcgccttcgtgcgccgcgccgcgcgcgaccgtcgcgctcgtgcacgggctcgccgagcacgcgggacgctatcaggcgttcgccgagcggctgaacgcggcgggcatcgaagtcgtcgcgatcgatctgcgcggccacgggcgctcgcccggcgaacgcgcatgggccgagcgcttcgaccggtatctggacgacgcggacgcgctcgtcgcgagcgccgcgcgcgagaacacgccgctcttcctgatggggcacagcatgggcggcgcaatcgccgcgctctatgcgatcgagcgcgcggccgcgcgccacgcgagcctggcgggcctgatcctgtcgagccccgcgctcgcgccggggcgcgacgtgccgcaatggatgctcgcgatgagccgcttcatcagccgcgtgtggcctcgctttccggcgctcaagatcgacgccgcattgctgtcgcgcgatccggccgtggtcgccgcgaatcgcgccgatccgctcgtccatcacggctcggtgccggcgcgcacgggcgccgagatcctcgacgcgatgcggcgaatcgaggccggccgcgcggcgctgcgcctccccgtcctcgtctatcacggcaccgccgacaagctgaccgagcccgacggcagccgcgacttcggcgcgcacgtcggctcgcccgatcgcacgctcacgctatacgaaggcaactatcacgagacgatgaacgatctggaacgcgagcgggtgatcggcgcgctgatcgactggatcgccgcgcgcgtgccggctcgcggttga

SEQ ID NO: 1066 - DNA, 1140 bp, Burkholderia pseudomallei
atgaaaaagaccctcatcgttgccgctctttccggcgttttcgcaacggccgctcacgcgcaaagcagcgtgacgctgtacggcctgatcgacgccggcatcacctacacgaacaaccaaggcggccacagcgcatggtcgcaatccaccggctcggtcaacggcagccgctggggcctgcgcggcgccgaggatctcggcggcggcctgaaggcgattttcgtgttggaaaacggcttcggcatcaataacggcacgctgaagcagaacggccgcgagttcggccgtcaggcgttcgtcggcctgtcgcacgagcaatacggcgcgctgacgctcggccgtcaatacgacagcgtcgtcgactacctcgggccgctgtcgctgacgggcacgcaattcggcggcacgcagttcgcccacccgttcgacaacgacaacctgaacaattcgttccggatcaacaacgcggtcaagtacacgagcgtgaactgggcgggcctgaaattcggcgcgttgtacggcttctcgaacaacaatcagttcgcgaacaaccgcgcctatagcgcgggcgtatcgtacagctacgccggcttcaacatcggcgccggctacctgcagttgaacaacaacttcggcccgacggtctccaacgcatccggcgcggtcgcgctcgacaacacgttcgtcggcaagcgccagcgcgtgttcggcggcggcctgaactacacgttcggcccggcaacggccggcttcgtgttcacgcaatcgcgcgtcaaccgcgcgacggcaatcggcgcgggcgcatcgggcgtgtcgagcggcattgcgctcgacggcacgttcatgcgcttcaacaactacgaagtgaacgcgcgctacgcgatcacgccggcatggacggtggccggttcgtacacgtacaccgccggcttcatcgagaaccaccacccgggctggaaccaattcaacctgcaaacggcctacgcgctgtccaagcgcacggacgtgtacctgcaaggcgtgtatcagaaggtcaacaacgacggcacgggcctcggcgcgtacatcaacggtatcggcggcatgtcgtcgacggaaaaacagatcgccgtcacggccggcctgcgtcaccgcttctaa

SEQ ID NO: 1067 - DNA, 801 bp, Burkholderia pseudomallei
atgaaggcattcaaaccgatgttcacgtcagcactcgtcgccgcgctgctcggcgtcgcggccgcgtccgcgcacgcggccgacctgctcgacagcgtcaagcaggccggcgtgctgaagatcgcgctcgaaggcacctaccctccgttcgactaccgcaacggcgacggccagctcgaaggcttcgacgtcgacgtcgcgaaggaagtcgccgcccggctcggcgtgaagccgcaattcgtcacgaccgagtggagcggaattctcgcgggcctgcaggcgggcaagttcgacgtgatcgtcaaccaggtcggcatcacgcccgcgcgccggcaggcgctcgacttcagccagccgtacgtgtactcggccgcgcagctgatccagcgcgccgacgacaagcacgactacggcgcgccgggcgcgctgcagggcaagcgcatcggcgtcacgctcggcaccaacttcgccgatctcgcgaagacgctgcagggcgtcgacgtgaagacctatccgggcgcgccggagaaactgcgcgacgtcgccgctggccgcatcgacgtcagcatggacgaccggctgatgctgccgtacctgatcaagaacgcgcacatgccgctgcggcccggcgcgacgatcaacggcggcgagacgcagatgggcatcccgttccgcaagggcaacccgaagttcgcgaaggcgctcgacgacgcgctcgcgtcgatgcgcgcggacggcacgctcaagaagatctcggtgcactggttcggcgtcgacacgtcggtcccgagcgcgcagtaa

SEQ ID NO: 1068 - DNA, 387 bp, Burkholderia pseudomallei
ttgttctattcgatcgtcgcgattttcgtcggcgccgggttcggcgcgttgctgcgctggttcctgagcatcggcctcaatgcgctcctgcccgaagtgccgctcggcacgctcgcgtcgaacctgatcggcggctatctgatcggcatcgcggtcgtcgcgttcgccacgcgtgcggggctgccgcccgaatggcggcttttcgtgatcacgggcttcatgggcgggctcacgacgttctcgacgtactcggtcgaagtgatgacgcacgcggtgcagggcgagttcggctgggcgctcgccgtggctgccctacacttgataggttcattcacgttgacggggcttggcatgtggaccgcgcgggcgtggctcgcgccggcctga

SEQ ID NO: 1069 - DNA, 639 bp, Burkholderia pseudomallei
atgagtctacgtcttggcgacatcgcgccggatttcgagcaggattcgagcctcggccgcatcaaatttcacgaatggctcggcaatagttggggcgtcctgttctcgcatccggccgactacacgcccgtctgcacgacggagctcggcttgaccgcgaagctcaagggagaattcgagaagcgcaacgtgaaggtgatcgcgctgtcggtcgacagcgtcgagtcgcacaagggctggatcgacgacatcaacgagacccaggcgacgagcgtcggctttccgatcatcgccgacggcgatcgcaaggtctcggaactctacgacatgatccatccgaacgcgaacgagacgctgaccgtgcgttcgctgttcgtgatcgatccgaacaagaaggtgcgcctcatcatcacctacccggcgagcaccggccgcaacttcgacgaagtgctgcgcgtcatcgattcgctgcaactgaccgatcactacaaggtcgcgacgcccggcaactggaaggacggcgacgacgtcgtgatcgtgccgtcgctgcaggatccggacgagctgaagcagcgctttccgaagggcttcaaggccgtgcgtccgtacctgcgcctgacgccgcagccgaacaaatga

SEQ ID NO: 1070 - DNA, 453 bp, Burkholderia pseudomallei
atgccatgtacggggcgcaattcgccctcgagaggcttcaccttaatcgaggtggtcgtcgcgatcgcgatcgtggcggtgctcgcggcgtttgccgtgccgtcgtatcgcagttatgtcgaacgggtgaaccgattgaccgcggttgccgcgctctatcgcgccgcgcaatacgtggacgcgttcggcgacgcgccgcccaccgcgttgccggaaggggtgaacagggcgcccgaatccggcaagctcgtctatgtgctgcggatcatgttcgacgacgcgcgcggcggatacgcactggaggcgcgtcccgccgccgatggtgcaatgcgggacgacagatgcggcgtctacgtgctgcatgcggacggcacgcgcgagaatcgcgtggccggaggcgtcgcgctcgatggcggtgcggcggagggcgatgcctgctggcgaacaggctag

SEQ ID NO: 1071 - DNA, 561 bp, Burkholderia pseudomallei
atgcgagcggagcgtgacaggtgggcaacggcgggcttcgtgctcgtcgaagtgatggctgcgctgatgctcgtggcgcttgccgcgatgctgaccgcgccgacgctcgccggcgctcgaatgcgcgatcgagtggacgcgcgggcgcgcgtgttcggcgcattgctcgcctatgcgcgcggcgaagcggtcaggctcggcgcgcgcgtggtgctgtgccgcagcgatgcgaccgcgaaatgcattgcggcggggcggccatgcggtggcggggcggccgattggtcgtgcggctgggccgtcgtcgccgcggatggcgaacgcggtacgcgcctgttgcggcgcattgcgcccgatgcccgagtggccgtgacgggcgcgactgtcgatgtcgtgttcacgccgcccgcgggccaggtgatcggcggcttccgaagtttcgagtttgcgccggcagacgcatcgggcgcatggcgcggggaacgctggcgccgctgcctgcgcatcgcggcgggtggtcgcgtgcgattcgccgagggcggttgcggagcgtcgacatga

SEQ ID NO: 1072 - DNA, 1953 bp, Burkholderia pseudomallei
atgggaaagatcatcggtattgacctcggcaccacgaactcgtgcgtcgcgatcatggaaggcaaccaggtcaaggtcatcgagaattcggaaggcgcgcgcacgacgccgtcgatcatcgcgtacatggacgacaacgaagtgctcgtcggcgcgcccgccaagcgccaatcggtgacgaacccgaagaacacgctgttcgcggtcaagcgcctgatcggccgccgtttcgaagagaaggaagtccagaaggacatcggcctgatgccgtacgcgatcatcaaggcggacaacggcgacgcgtgggtcgaggcgcacggcgagaagctcgcgccgccgcaggtgtcggccgaagtgctgcgcaagatgaagaagacggccgaagactacctcggcgagccggtcacggaagccgtgatcacggtgccggcgtacttcaacgacagccagcgccaggcgacgaaggacgcggggcgcatcgcgggcctcgaagtcaagcggatcatcaacgagccgaccgcggccgcgctcgcgttcggcctcgacaaggccgagaagggcgatcgcaagatcgcggtgtatgacctcggcggcggcacgttcgacgtgtcgatcatcgagatcgcggacgtcgacggcgaaatgcagttcgaagtgctgtcgaccaacggcgacacgttcctcggcggcgaggacttcgaccagcgcatcatcgattacatcatcggcgaattcaagaaggagcagggcgtcgatctctcgaaggacgtgctcgcgctgcagcgcctgaaggaagcggccgagaaggcgaagatcgagctgtcgtcgagccagcagaccgaaatcaacctgccgtacatcacggccgacgcgtcgggcccgaagcacttgaacctgaaggtcacgcgcgcgaagctcgaggcgctcgtcgaggatctggtcgagcgcacgatcgagccgtgccgcaccgcgatcaaggacgcgggcgtcaaggtgtcggacatcgacgacgtgatcctcgtcggcggccagacccgcatgccgaaggtgcaggagaaggtgaaggaattcttcggcaaggagccgcgccgcgacgtgaacccggacgaagccgtcgcggtgggcgcggcgatccagggccaggtgctttcgggcgaccgcaaggacgtgctgctgctcgacgtgacgccgctgtcgctcggcatcgagacgctcggcggcgtgatgacgaagatgatcaacaagaacacgacgatcccgacgaagcacgctcaggtgtattcgacggcggacgacaaccagggcgccgtgacgatcaaggtgttccagggcgaacgcgagatggcggcgggcaacaagctgctcggcgagttcaacctcgagggcatcccgcccgcgccgcgcggcgtgccgcagatcgaagtgaccttcgacatcgacgcgaacggcatcctgcacgtcggcgcgaaggacaaggcgaccggcaaggaaaacaagatcacgatcaaggcgaactcgggcctgtccgaagccgagatcgagaagatggtgaaggacgcggaagcgaacgcggcggaagaccacaagctgcgtgagctcgccgaatcccgcaaccagggcgatgcgctcgtgcacagcacgaagaaggcgctcaccgagtacggcgacaagctggaggcgggcgagaaggagaagatcgaagcggcgctcaaggagctcgaggacgtgctgaagaacgcgtcgagcgacaaggcggcgatcgacgcgaaggtcgaagcggttgcgacggcgtcgcagaagctcggcgagaagatgtacgccgacatgcaggcgcagcaggcaggcgccgcgggcgcggccggggcggcagccgaaggtgcgtcggcgcagggcggcgcgcagccggccgacgacgtcgtcgacgccgacttcaaggaagtgaagaaggactga

SEQ ID NO: 1073 - DNA, 390 bp, Burkholderia pseudomallei
atgccggagtcgccgaaccaatttccgccgtcgtaccagagcgcgaccgagagcgaacgccagcagtcgttgcgtacgctgacgcacatcctctatctgctgtacgcgattcactggctgacgggcggcattacgggcatcgtcgcgatcatcatcaactacgtgaagcgcgacgacgcggtgggcaccgcgtatcaggctcatttcgaatggcagatccgcacgttctggcgcgcgctgatcgcgtatctgatcggcttcgcgctgctgctcgtcgggatcggcttcatcgtgctgggcgcggtgtggatctggacgctgtaccgtatcatcaaaggctggctgtacttgaacgacaacaagacgctcgatccgcaggcatggttctga

SEQ ID NO: 1074 - DNA, 333 bp, Burkholderia pseudomallei
atgaccgttctggaactgaacgagctggtcaaggcgttcgaagagaagtttggcgtgtcggctgctgctgttgcagtcgcgggcccggcagccggcggcgccgctgctgcagctgaagagaagaccgagttcacggtcgttctggctgaagcgggcagcaacaaggttgcagtcatcaaggccgttcgcgaaatcacgggcctgggcctgaaggaagcgaaggacctcgtcgacggcgcaccgaagcccgtcaaggaaggcgtcgacaaggcttcggcagacgaagccaagaagaagctggaagacgcgggcgcgaaggtcgaactcaagtaa

SEQ ID NO: 1075 - DNA, 1191 bp, Burkholderia pseudomallei
atggccaaggaaaagtttgagcggaccaagccgcacgtgaacgttggtacgattggtcacgttgaccacggcaagacgacgctgacggcagcgatcgcgacggtgctgtcggcgaagttcggcggcgaagcgaagaagtacgacgaaatcgacgcggcgccggaagaaaaggcgcgcggcatcacgatcaacaccgcgcacatcgagtacgaaacggcgaaccgccactacgcacacgtggactgcccgggccacgccgactacgtgaagaacatgatcacgggcgcggcgcagatggacggcgcgatcctggtgtgctcggccgctgacggcccgatgccgcaaacgcgtgagcacatcctgctggcgcgtcaggttggtgtgccgtacatcatcgtgttcctgaacaagtgcgacatggtggacgacgcggagctgctcgagctggtcgaaatggaagtgcgcgaactgctgtcgaagtacgacttcccgggcgacgacacgccgatcatcaagggttcggcgaagctggcgctggaaggcgacaagggcgagctgggcgaagtggcgatcatgaacctggccgacgcgctggacacgtacatcccgacgccggagcgtgcggtcgacggcgcgttcctgatgccggtggaagacgtgttctcgatctcgggccgtggtacggtggtgacgggtcgtgtcgagcgcggcgtgatcaaggttggcgaggaaatcgaaatcgtcggtatcaaggcgacggcgaagacgacctgcacgggcgtggaaatgttccgcaagctgctggatcagggtcaggcgggcgacaacgtcggtatcctgctgcgcggcacgaagcgtgaagacgtggagcgcggccaggttctggcgaagccgggttcgatcacgccgcatacgcacttcacggctgaagtgtacgtgctgagcaaggacgaaggcggccgccacacgccgttcttcaacaactaccgtccgcagttctacttccgtacgacggacgtgacgggctcgatcgagctgccgaaggacaaggaaatggtgatgccgggcgacaacgtgtcgatcacggtgaagctgatcgcgccgatcgcgatggaagaaggtctgcgcttcgcgatccgcgaaggcggtcgcaccgtcggcgccggcgtcgtcgccaagatcatcgagtaa

SEQ ID NO: 1076 - DNA, 678 bp, Burkholderia pseudomallei
ttgaaaacttcgaagacagttctggcgtgcctcgcggcatcggccatcgtcgcattgtccggctgcgcgaccgaggcgtcgcgcacgctgcccgtgccgccgtcggcgagcgcgcagaagccgttcgccggcaagccggtcggcatcgcggtcggcaagttcgacaaccgttcgagctacatgcgcggcatcttcaccgacggcgtcgaccgcctgggcggccaggcgaagacgatcctcgtcacgcagctccagcagagccgccgcttcaacgtgctcgatcgcgagaacctcgacgagatcaagcaggaagccgcgttcatgaagaaggcgcaggcggtgaagggcgcgaactatgtcgtgacgggcgacgtcaccgagttcggccgcaaggaagtcggcgatcagcagctgttcggcattctcggccgcggcaagagccagatcgcgtacgcgaaggtgaatctgaacatcgtcgacacgacgacgtcggaagtcgttctgtccagccagggcgcgggcgaatacagcctgtcgaaccgcgagatcatcggcttcggcggcacggccggctatgactcgacgctcaacggcaaggtgctcgatctcgcgatccaggacgcggtcaatcacctcgtcgaacaggtcgacgcgggcgcgctcgcgtccggcaagtag

SEQ ID NO: 1077 - DNA, 318 bp, Burkholderia pseudomallei
atgcatccgatcgtaaggcgtctattgctcgtcgctgttttcagcccgctctcggctgcggcgttcaacgaggagcaggggtacaaccaatgcatcctcaatgcgttgcgaggaagccggaatccgaccgcgacaggcctcatgcgcaatgcatgtgaccagctctatcgaaactgggcgatgcttcagccgcgcgatcgcgcctatcacacgtgcattctggatagcctcggggacgtgaaggacacttacgccgtgcagcaactcgccgcggcctgttctcgacagagcgaaggcgcaggccccacgttcaagtag

SEQ ID NO: 1078 - DNA, 1395 bp, Burkholderia pseudomallei
atgagtactgctgctttggtagaaggcaagatcgtacagtgcatcggcgccgttatcgacgtggaattcccgcgcgagagcatgccgaagatctacgacgcgctcattctggaaggctcggaactgacgctcgaagtccagcagcagctgggcgacggcgtggtccgtaccatctgtctgggtgcctccgacggcctgcgccgcggcgtcgtggtgaagaatacgggcaatccgatttcggtgccggtcggcaagccgaccctcggccgcatcatggacgtgctcggccgcccgatcgacgaggcgggaccgatcgagagcgaaaacaagcgctcgatccaccagaaggcgccggcgttcgacgagctgtcgccgtcgaccgaactgctcgaaacgggcatcaaggtcatcgatctgatctgcccgttcgcaaagggcggcaaggtcggcctgttcggcggcgcgggcgtgggcaagaccgtcaacatgatggagctcatcaacaacatcgcgaaggagcacggcggttactccgtgttcgcgggcgtgggcgagcgtacccgtgaagggaacgacttctaccacgaaatgaaggactcgaacgttctcgacaaggtcgcgctggtgtacggccagatgaacgagccgccgggcaaccgtctgcgcgtggcgctgacgggcctcacgatggccgagcacttccgtgacgaaggcctcgacgtgctgttcttcgtcgacaacatctaccgtttcacgctggccggtaccgaagtgtcggcgctgctcggccgtatgccgtcggcagtgggctatcagccgacgctggctgaagaaatgggcaagctgcaagagcgcatcacgtcgacgaagaagggctcgatcacgtcggttcaggccgtgtacgtgcctgcggacgacttgaccgacccgtcgccggccaccaccttcggccacttggacgcaaccgtcgttctgtcgcgtgacatcgcatcgctcggtatctatccggccgtcgacccgctcgactcgacgtcgcgccagatcgacccgaacgtgatcggcgaagagcactactcgatcacccgccgcgttcagcagacgctgcagcgctacaaggaactgcgcgacatcatcgcgattctgggcatggacgagctgtcgccggaagacaagctgtcggttgcgcgcgcacgtaagatccagcgtttcctgtcgcagccgttccacgtcgccgaagtgttcacgggctcgccgggcaagtacgtgccgctgaaggaaacgatccgcggcttcaagatgatcgtcgacggcgagtgcgaccacctgccggaacaggcgttctacatggtcggcacgatcgacgaagccttcgagaaggccaagaagatccagtaa

SEQ ID NO: 1079 - DNA, 1953 bp, Burkholderia pseudomallei
atggtcgaaacgagacgcatccacgttgtgctcctcgccgcggcgatcacggcgatcacggcgatcgccgcgatcgcgccggccggtcacgcgcaaaacgccaccgactggctggcgaacacctacggcaccctcgccgcccacgtgggcaacaccgcgcgttcgatgtgggtcgcgcccgaaggcgtcatctacacggcctcgatgtgggacgaatacgagggtggcgtcgcgatctaccagaacggcaagagcgtcggttcgatcggctcgcacgcggagtttcagggcggcgcgatcacgggcaacgcggcgtcggtcttcgtcgcgctccagtacgacaagtcgcacggcagcggcgcggtcgggcgatacaaccgcgtgaccaaggcgcgcgagctgtcgattcaggtcagcgcatcgaccgatcagccccgggtcgacgtcgtcaccgggctcgccaccgtgggctcgctcctctatgcgagcgacttctacggcaatcgcgtccgcctcttcacgaccgacggcgtctggcagcgcgacatcggcgtggcgggccccggcgcgctcgccgtggatcgcgcgggcaacgtctgggtcgcgcgcaagcgcgcgggcgagatcgtcgaattcagcgcggccggcgcgttgctgaacaccctccggatgcccggcggatcgcagccgtcggcgctctatttcgacgcgccgtcggggcaactgatggtcggcgacgaggggccggacatgaacatcaagcgctacgccgtcacgggcgcgccggcgctcgtcggcacattcggcattcagggcggctatctcgacacgacgacgggaatcaaaggccaggtgggcgcgaggcgcttcacgcgcgtcgccggcatcggcaaggacgccgccggcaatctgtacgtgctcaacaacccgtggggcggcagctgggacctcggccgcaacggcgccaccgacattcacgcgtacgacagcgccggcaacctgcaatggacgctccagtccctgaacttcgagggcatcgccgcggcggacccggctacggacggcgcgctgttctacggcggcacccatatctacgccggcagcgccggcggcacgttcgtcgcgaacaccgtcgatccgttctcctatccgtcggacccgcgcatcgacatgaacgatacgcagcgcgacgagcatttcgggcaactcgtcgccgtcggcgcgaaccggattctcgtggcgtcgggccagaatccgccgatcttctactttttccatttcaacaaggcgaatggctacgtcgcgattccggacgcgtcgctgccgggcgcggcgttcaatacggcccagcgggtcacgagcggcttctgcatcgacagcgagggcggcgtgtgggccggcctcgagaagaccggcgcgatctaccactacccgctggccggcttcgacgcgagcggcaagccgacatggggcgccggcgtgccgacccgcattccggcgagcattcagccgctgacgcgcatcgtctacctcgcggagagcgacacgatgattctcgcgcaaggcatcgtcggcagcgccgattggacctcgatcggcacgcgaatcgaggtgtatcacggctggcgcgcgggcaacaccgccgcgcccgatccggtgatcacgctcgccaacgccggcgcgaagtcgatcgacgcggccggcaaccatctgttcgtcggctactggttcggcggcggtgggccggcgcggccgaacgtcgatgcgttcaacctcgccacgggcaagcttgacgccacgctcgtcaacaccagccgcgccaccgtggacgcgagcagcgccgtcgattcgatgtacggcgtgcgggcctatcagcgatcgacgggcgagtacgtggtgacgaagaacaacgtcaagggcaacagcatcaccgtgtatcgctggaagccgtga

SEQ ID NO: 1080 - DNA, 573 bp, Burkholderia pseudomallei
atgattgagatgaatgggctgaaattcaggagaggcgcggcgcgccgatggccgtcgatcgccgctgccgcaatgttcgcggcttcggcggcctgcggcgcgccgccgtcgccgaccgtgacgatcaaattcaagggaagctacaacccggtgacttgcacggtcgtggagggcaacgagaacaaaacggttcacctgccgacgatttcgacgtcgtcactggcgaatgcgggggaaaccgccggcgcgaccgggttcgacatttccgtgctttgcgacggatacgcgggaaacgtgctggcctatttcgagaacggaccgacgaccaacgagaacggcaatctcgacgtcgaggacccgagcgacggacagagcgcctccggcgtgcaggtccagctcctgaacggtgacggctcgcctatcaaggtcggcgacatatcgacgatgaagacggtgtccgtcgaagcgtcgacgcctacgccgattcccttcttcgcgcgctactacgccaccgggaagtccggtgcgggcaaggtgcgaacctatgtgaccttcgtgatccagatgctttga

SEQ ID NO: 1081 - DNA, 648 bp, Burkholderia pseudomallei
atgaaaccaaaaatcacattttacgcaatttcaattatcatcgcgcaactttggtcggctaatattcaagccgatacaccaaacttggatctcatggtcaagggcacaattgacgtgccgagctgcactgtctccgttgcgaacaacggcatatacgattacggaaagatcttgccgacgataataacgagcggcacgggtcataccgatctcggaaaaatgacaaaagcttggtccgtaaattgcgatgccaacaccttcatgactttcaaggtaacagacaatcgcagcgaatctgccagcgtttcatcgcacgacagtaggacgttgaatacgttcggccttggcatggtcaacaaaacaggcaagctaggctactacacgattaaaatgacaaatcccaccgttgacggcgaagcaacgaaattatttaatactttacagaccagcgacacggacatctatgtccgtcattcggatataatccaaggttgggggtcgccgaatagtcttgctataggcagagattttacggccgacctgacagtcaatgcctatctggctggaacaagcatcatggcgggtccgctcaccgaatcgatcgacctggatggctcgacaactttgtcattcgctttcggcctataa

SEQ ID NO: 1082 - DNA, 657 bp, Burkholderia pseudomallei
atgaagctgaaaacctctcttctcgcgctgtccatcgccatgctcggtacgacggcggctcatgctgccgcaccgactcaagatctcatcgtcaagggctcgattgatgtgccggcctgtaccgtcgttgccgccgacaatggtgtgtacgactatgggaaaatctctccgacgctcatcaagagcggcacggcgactacgccgcttgccaagatggaaaaggcatggaccgtgaactgcgatgccgaaacgtatatgagcttcaaagtgacggacaatcgcagcgattcggcgagctccggcgacaacacggcatttggcctgggtaaggtcaacgagaccggcaaattgggttactactcggtgacgatgcaagatgcgcaggtagacggcaaaaaggcgcgagtgtatgcaacgcccagcacgtctctcggtggtacgggagttgtcgccacgtatcaaaaactgaataagctcccgagctacacgcatgggtgggcaaacgagagctccgcgacgcaactcgcaggcaagaatttcactgcgaacatggtcgtcgaagcggttctcgccggcaccgaaacgatgggtggcgcgctaaaggacgcagtcgatctggacggctccgcaacgctgactttcgcgttcggcctctaa

SEQ ID NO: 1083 - DNA, 948 bp, Burkholderia pseudomallei
atgttggagatcaagcacaagctcgttcagaccgccgccgcgtgcgcgctcgcgttcgccgcgtgcgccgcgcacgcggccgacaaaccgctcaagtcgatcggcatcaccgtcggctcgctcggcaatccgtacttcgtgaccgtcgtgaaaggcgcgcaggcgcaggcgaaggaaatcaatccgagcgcgaaggtcacggcggtatccgccgattacgatctgaacaagcagttcacgcagatcgacaacttcatctcggcgcacgtcgacatgatcctgctgaacgcggccgacccgaaggcgatcgagcccgccgtgcgcaaggcgcaggcggcgggcatcgcggtgatcgcggtcgacgtcgcggcgtccggcgcggacgcgaccgtgcagacgaacaacgtgaaggcgggcgagctcgcgtgcgattacctcgcgaagaagctcaacggcaagggcaacgtgatcatcgagaacggcccgcaggtgtcggccgtcgtcgatcgcgtgaacggctgcaaggcggtgctcgcgaagaatccgggcctcaggctgctatcgagcgaccaggacggcaagggctcgcgcgaaggcggcatgaacgcgatgcagggctacctcacgcgcttcccgaaagtcgacgggctcttcgcgatcaacgatccgcaggcgatcggcagcgatctcgccgcgaagcagttgcgccgcaccggcatcgtgatcacgtcggtcgacggcgcgcccgacatcgaaaccgcgctgacgagcgacacgcaggtgcaggcgtcgtcgagccaggacccgttcgcgatggcgaagaaggccgtttcggtcggctacggcatcatgaacgggcacaagcccgcgaacgcgatgatcctgctcgagccgacgctcatcacgcgcgagaacgtgaagcgctacaagggctggagcgcgcattga

SEQ ID NO: 1084 - DNA, 639 bp, Burkholderia pseudomallei
atgtccgaagatcttcgcgtcggtctttttccggttcgctatctcgtcggcaccggcttgcccggcgcgccgcagctcgtgctggatctgatggtcgacacggtcgatcacagcgtcgtcggccgcgcggcggtctcgcaagccgtgagcccgccgctcaatttccacgccgacgtctggggctcctacgtattccggctcggcccgccgccgcgccgcgacggcagcggcgcgatcgtgcagatctcgctgcagggcaaccagggcgggccgcagtcgaattcgatgatcacgttctacggcgagctgctgctcaagggcgacggcaagacgggcgtcgcatcgtaccgctactactcgaacggctcctggcacgaagtcgagaacgtgccggtcaaggccgacccggagctcgtgccgatcgagccgggcccggtcatcggccaatcgtcgatgagcgcgatcggatcggccgcgatgtacggcgtggcgatccagtctgcggccgcttccggcgatctcgcgcacatgcgcacgctcagtgcctatgcgcggcagcagctggaaagccgtgacgaaatcgcggccgcgctgagcgagctgaaggcggaaatcgccaagctcgaaagccggcagtga

SEQ ID NO: 1085 - DNA, 1422 bp, Burkholderia pseudomallei
atgacaaccaaccaacgagaatccactgtttctctgcggcgcgcttgcgcgtcgctagccgcgctggcgctgcttgcggcctgcacgtcgacgcccgaggcgatccagcgcaagacgggctggatgcgcagcgaagtcgccgattcctatatctacgcctacccgctcgtgctgatggacgtcgcgaaggaagccgcgacggccgacggcgcgcccgtcaacacgctgcgccacgcgcaggcgctgcccgcgccgggcgccgcgaacccgccgctcgcgagcgtcgacatgctcgattcgaccgcgtggctcgacgttgccgacgagccggtgatcgtcgcgctgcccgacgggcgcggccgctatctcgacgcgcgcgcgctcgacatgtggaccaacgtgctgtggtcgaccggcccgtcggcgaatccgcgctcgggcgcgagccgcgcgcgcacgctcgcgttcgtcggcgcgggctgggagggcacgctgccggaaggcgtgacgcgcgtcgacgtgcccgcgcgcaacgtgtggctcgacgtgcggatccagacgagcggcgggcgcgatctcgccgccgcgaggaaactgcagcgcgcgattcgcgtcgagccgctgtccgtctatacgggcgacgcccgcggcgcgcgtgcggatgcgggcgcagcgtcggccgagcccgcatcgggcgccgccgcgtcgcctgtcgcgcaggtcgcggcgctcgatccgccggcgttcttctcgcgcgtcgcgcgcgcgctgcaggacaacccgccgcccgccgccgatgcgcacgcgcaggaaatcctcgccgacatcggcgtgacggcgggcgcgccggtgcaatggaagggcgacaagctgatcggcgccgagaacggcgcggccgaggcgcgcgagcggctcaccgcgctgccgccgaacgcgctttccgcgaacggctggagctggctcggcgacagcgtcggcaactacgggcaggattacgcgttgcgcgcgtacgcggcgtcgacgcaattcggcgcgggaacgcgcgacgacgaaaccgtcgccgtcgtgaagaccgacagcgcgggccggccgctcaacggcgcgcaccgctacgtgatccgcttcgcgccgaacgcgctgccgcccgcgcgcgcgttctggtcgctcgcgccgtacacgccggacggcgcggtgcccgagctcggccgcgcacgccgctcgatcggcgagcgcgaccggctgcgccgcaaccgcgacggctcgctcgagatcgtcgtatccgcggcgccgcccggcaaggggtacgcgtcgaactggttgcccgcgccgcgcgccgatttcgagctcgcgctgcggctctacgcgccgaagcggcaggccgccgacggcacctggcagccgcccgccgtcgtccgcaagtga

SEQ ID NO: 1086 - DNA, 1200 bp, Burkholderia pseudomallei
atgaaaaaagcggcagcagcatggttggtggcggggagcatgtgcgccggcgcgcacgcgcaaggcacggtgacgctctacgggatcgtcgacgcggggctcggctatacgagcgaccagcgcgtcgcgcagaccaagggggcgctcggctcgcccgtcggctaccgcaatgagtcgagctacggcttcgcgagcggcacctggtcgggcagccgctgggggctgaagggcaaggaggagctgggcggcggtctcgcagccgtgttccagctcgagaacggttttaacatcggcaccggacaggcgggacagggcgggcgaatgttcggccggcaggcgtggatggggctgtcgagcgaacgctacgggacgctcacgatggggcgccagtacgatccgatcgtcgacttcgtcggcacgatcggcgcgggcgcgttcctgaccggcatgggcgcgcatccgggcgatctcgacaacatcgacaatcaggcgcgcgagaacaactcgatcaagtacgtgagcccgaagttcggcggcctcgcgctcggcgcgctgtacggcttcggcaatcaggcgggcagcgtgaagaaccagaacacgtggagcgtgggcggccagtatgtgaacgggccgttctcgctcggcgccgcgtacctgtatgcgacgaacgcgtacggcgcgaacggcggcgcgtggacgggttcgtacgacggcacgttcgcttcgtcgatcaacgaaggcttcgcatcggcgaagagcatgcagatcgtcgcggcggcgagcacctatcagatcggcgcggtgacgctcggcctgtcttacagcaacacgcggtacaaatccggcgcgttctcgacgttcaacggcaccgcgacgtacaactcgatcggcggcaccgtatcgtggcaggcgacgcccgagctgcgcgtcgcggcgggctatgatttcacgcgtggcagctcgatcgacggtcagtccgcgccgaaataccatcaggtgaacttcgcgtcgtactactacctgtccaagcgcaccgcgctgtatggcctcgtcggttatcagaaggcgagcggcaagacgctcgatgcgtacggcaacgtcgtcgcggcgacggcgtcggtcggcgacgtcggcaacggcatttcgtcggcgggcgatacgcagacgctcgtgcgcatcggcgtgcgtcacacgttctga

SEQ ID NO: 1087 - DNA, 426 bp, Burkholderia pseudomallei
gtgcggcaccgggcgggcttcaagcatcacgtgaagcgcggcgagcaccctacggcaactgcatcggatcgcgagcattacgccgagttcggcgacaagatgagcgccgacgacgcgaagcacgtcgagacggaatcgatcgaggcggccgtgttccgcaaggccgtatgcgccggcttcgatcacaagagggtcgccctcgcgttgatgaagcgcggcgggcgcagtgccgccaaccgccgcacgccgacatgccaatcgggcatggcggccgattcgcggaatattggagaagcccggtgtgctcgacggctttgctcacaatcgctcctgtttccatgtccacgtggtgcacttgaaacagagactttgcaaggtcaatcgatagtgacgaactgcgcaggtggagcctaccagttcaggtag

SEQ ID NO: 1088 - DNA, 1353 bp, Burkholderia pseudomallei
atggacatcatccgccccacgttcgcgccggacgccgcgcgaagcccggacgccatccgcgcggaaatcgccgcgctggttcgagagtatgcgaacgcgacgcaggcgcgcgctccgttcgtgccgggccgcacgcccgtgcccgtgtccggcaaggtgatcggcgcgccggaactgcagcacatggtggatgcgagcctcgacggctggctgacgacggggcgcttcaacacggccttcgagaacaggctcgcgcgctatctgggcgtgacgcacgtgatcacggtgaactccggttcgtcggcgaatctcgtcgcgttctcgacgctgacctccgatcgcctcggcgagcgggcgatccgccccggcgacgaagtgatcggcgtggccgcgggattcccgacgacggtcaatccgatcctgcaattcggcgcggtgcccgtgttcgtcgacatcgaactcggcacgtacaacgtcgacgcgacgaagctcgaagcggcgctctcgccgcggacccgggcgatcatgctcgcacactgcctcggcaacccgttcaacgtcgaggccgtgacctcgctgtgccgcaagtacgggctctggctgatcgaggactgctgcgacgcgctgggagcgcggtacgacgggcgactcgtcggcacgttcggcgacatcgcgacgctgagtttctacccggcgcaccacatcacgatgggcgagggcggcgcggtgttcaccaataacgacgagctcgcgcgcatcgccgaatcgttccgcgactggggccgggattgctactgcgcgccgggtgccgacaacacctgcggcaagcgcttctgctggcagctcggcgagctgccgcgcggctacgaccacaagtacacgtacagccactgcggctacaacctgaagatcaccgacatgcaggccgcttgcgcgctcgcgcagatggatcgcgtcgacggcttcatcgagcggcgccgcggcaacttcgcctacctgaaggagcggctgtcgtcatgcgatgcgttcctgcatctgccgcaggcgacattcaattcgaatccttcgtggttcggctttccgctgacgctgagggaggacacgggcgtcgcgcgggtcgatttgctcgattacctgagccagggcggcgtcggcacgcgcctgctgttcgcgggcaacctgacgcgccagccgtacatgcggcatcggcggtatcgcgtgagcggcgagctggcggtcacggacgccgtgatggagcgcacgttctggatcggcgtctttccggggctggacgaagcgatgctcgattacgcgtgcacgaagatcgagacgttcctgggcatcaacttttga

SEQ ID NO: 1089 - DNA, 1665 bp, Burkholderia pseudomallei
atgacggcgcgcttcgtttccctccggatcggcgcggcggcggccgtactggcgttcgccgcgggctgcacgacattctcgcgggacggcggcttcggcgccgtgtcgagcgcggccgccgagcggctcggccaggacgcggtgctggtgaagaccgacgccgatcgcgatgccgtggcgcgtcgcacgcaggcgctgctgtcgaagccgctcggcatcgacgacgcggttcagatcgcgctgctgaacaaccgcggcctgcaggcttcgtatgcggagctcggcctgtccgaggccgatctcgtgcaggcgggacggctgccgaaccccggcttcacgttcagccgcacgcattcgagcaacgacctgagcatcggccgcacgttctcgatgagtgtcctgagcatgctgacgctgccgctcgcgacgaagatcgaggggcggcgcttcgagcagaccaagctcgagaccgccgacgcgatgctgaaggtcgcggccgacacgcgccgcgcgtacgtcgaggcggtcgccgccgcgcaggcggcgacctacgcggagcaggtgaaggattcggcggacgccggcgcggagctcgcgctccggatgcggcgcgccggcaacttcagccggctcgattacgcgcgcgagcaggcgttctacgcggacgcggtcgcgcagctcgcgaacgcgcggctgcgcgcggtcgccgcacgcgagaagctcacgcgcgcgatggggctgtggggcgcgtcggccggctatgaactgcccgagcgcctgccggagctgccggccgaacggccgcggctcgacgacgtcgagcgcttcgcgatggaccaccgcctcgacatccgggccgcgaagctgaggacgcagggcgtcgcgagctcgctcgggctcacgcaggcgacgcgcttcgtcaacgcgctcgaactcggctacctcgacaactacgagaccgacaaggggcacgagcacggctacgagatcagcgtcgagattccgctgttcgactggggcggcgcgaaagtcgcgcgcgcgaaggcggcctacctgcaatcggcgaaccggctcgcgcagacggcgatcgacgcgcgctccgaagtgcgcgaatcgtacgcggcgtacgtgacgcgctacgacatcgcgaagcactatcgcgacgaggtcgtgccgttgcgcaagacgatttccgacgagatgctgctgcgctacaacggcatgctcgtcagcgtgttcgagctgcttgccgacgcgcgcgatcagatcggcgcggtgaacgcctatatcgatgcgttgaaggactactggctcgcgcaagccgatctgcagcaggcggtgggcgggcgtttgccgcgcggcgcgcaggcggccagcgagccgccggcggcgacgccggcttccgcggccgccgccggcgcgcgcgccgcggcggtggcctcgggcgcggcggcgccggcgagcgaggccacgtcggtgtcgtcgtccgcgtccgtgtccacatccgcgtcggcgtccatgcccgcaaccacgcccgcatccacggcagcgtcggcccccgcgctcgcatcgcctcgcgcgatcgcgacggcggtctcctcccacgcgcacgagccggcttcgttatccggcgccgtgccactcacgaattcgaaaggtcaatga

SEQ ID NO: 1090 - DNA, 1122 bp, Burkholderia pseudomallei
atgagtgtgagccatcttcgtcatgcggtcgcgcgcgcagcgctcgtcgcgctcgccggcgcgtcggcgctcgccctgccggccgcgcacgcggccggcgccgagctgaacgtgtacaactggtcggactacatcgcgaaggacacgatcccgaacttcgagaagcaatccggcatccacgtcaagtacgacaactacgacagcgacgacacgctgcaggcgaagctgctcgcgggcagctccggctacgacatcgtcgtgccgacgtcgaactacatggccaagcagattcaggcgggcgtctaccagaagctcgacaaatcgaagctgccgaacctgtcgaacctcgatccgacgctgatgaagatgatcgccgacgccgatccgggcaaccagtacggcgtgccgtgggcgttcggcaccgacggcctcggctacaacgtgcaggcggtgaagaaggcgctcggcgagaacgcgcccgtcgacagctgggcgctcgtgctcgatccggcgaacgtatccaagctcaagggctgcggcgtatcgttcctcgatcaggcggtcgacgtgttcgccgcgacgctacaatacatgggcaggaatccgaacagcacgaacccggccgattaccaggcggcgttcgaggtgctgaagaaagtccgcccgtacatcacgcaattcaactcgtccggctacatcaacgatctcgcgaacaacgacgtatgcgtcgcgctcggctggtcgggcgacgtcggcatcgcgcatcgccgctcggccgaggcgaagcgcccgtacgacatcaagttctcgaatccgaaggaaggcggcctgctgtggttcgacgtgatggtgatcccgaaggatgcgccgcacgcggaagccgcgctgaagtggatcaactacatcgaggacccgaaggtcaacgcggcgatcaccaacgaagtgttctacccgagcgcgaaccgcgcggcgcgacagttcgtcgtgcccgccgtcgcgcaggacccgaccgtctacccgcccgaggacgtgctcaagaagatgacgctgatgcggccgatgcccgccgacatcctgcggctcgagaaccgtctgtgggcgcaattgaagacgggacactga

SEQ ID NO: 1091 - DNA, 1665 bp, Burkholderia pseudomallei
atgcattcgatgtcgaaccctcgcttacgcttttcctccgtcgtttacggcctcatcgcgctcgccgcgtgtgcaagcttcgccgcgcatgcgtcgggcgcgcgatgcgcggcatcgcccgcgaagtccgccgacggcacgccgcaatggcggcccgcgttgcactacacgccccgacgcaactggatgaacgacccgaacggcctcgtctacgaaaacggcgtctatcacctgttctatcaatacaatccgcacggcaacttctgggacgacatgtcgtgggggcacgcgacgagccgcgatctcgtgcactgggacgagcagccggtggcgatgccggcgaacgcgcgcgaggatatcttctccggctccatcgtcgcggacgcacgcaacacgtcgggcctcggcaccccgaatgcgccgccgctcgtcgcgctctatacgagcgtctacaaggcgggctccggccacgaacccggtacgcaggcgcaatcgctcgcgtacagcatcgatcacggcaagacgtggcggccgtacgcgcacaatccggtgctgacgctcgcgcccgaatcgcggcatttccgcgatccgaacgtgacgtggtacgcgccgggcggctactggatgatgacggcggttgtcgccgacgcgcccgtcgtcaagctgtatcggtcgagcgacctgattcgctgggatttcctgagcgacttcacgctgcccgacgtcccgcatcgcggcgcgctgtgggaaatgcccgagctgctgccgatgccgctcgacggcgacgccgcgcgcatgaagtgggtgatgatcgtcaacgtcaatccgtggtcgatcgcgggcggctcgggcgcgatgtatttcatcggcgagttcgacggcagaacgttcacgcccgatcgcgccgcgccggcgaacgccgatcccgcgcaatactcgtggctcgatcacggtgccgactactacgcggccggcacgttcgcgaacgcgccgggcgaggggccggtagcgatcgcatggatgagcaattgggactatgcggagcgcattccgaccacgccgtggaaaggcgcgatggcgttaccgcgcgagcttgcgctgaagacgatcgacggccggccgcgagtgacggtcgcgcccgcgcgcgcgttcgacgcgttcgcccgcacgcggcccgccgtgcgtatcggctcgctcgcggtcgcgtccgcgacgcgagagctcggcgccgacgcacgcggcaccgtgcagcgcatcgcagtgacgatcgagccgcgctcggccaggcgcgccggcttgatcgtgcggcgctcggcgaacggccgcgtcggcacgcgtatcgtctacgattcgtcggcgcacacgctgagcgtcgatcgctcggcatccggcgaaacgaacttctcgaacgcgttcagccagcggcatatcgttgcgctaccgctcgtgaacgggaagctgcggctcgacgtgatcgtcgatcgcgattccgtcgaagtgttcgacggcgacggccggaccgtcatcaccgatctcgtgtttccgtcgcctgccgacaaccggctcgccgtgttcgccgaaggcggcgacgcgacgttcggcgatgtcgtggtgacgaatctcgacgagaccgcgggcgagcggcgagggtgcccgacctcatag

SEQ ID NO: 1092 - DNA, 1704 bp, Burkholderia pseudomallei
atgcagacatcccgtaaagcactgccgctcgcgctgggtcttgccatcggcctcggcgccgcgctgcccgcgtgggccgattcgaaggcaccgagcccgcaggaggaaagccggcgcgcgagcctcacgcgcggcgtcgtggcgcctgcggaacaggccggcaagaccgggcagttccgccccggggccgttgccgtgacgctggcgagcccggcgtttcatgcgaagaaggccgatgcggcggcgatggcgcgcgagtacgtcaccgcgcgcgcagcgcagctcggcctcgacaaggccgcgctcgcgaatctcgtcgtcgcgtccgaacgcgccgacgccgcgttcaccgtcgtgcgcttccagcagcgcgccgcggggctgcccgtctatgacagcgacatcgcggtcacggtcgcgccggacggccgcgtgctgtacgtcgcgagcaaggcggtgagcggcgtcgcggccgtgtcgagcaagacgcaggcggtcgacgagcagcaggcgctcgaccgcgcgcgcgcctacctcggcgtcggcggcttcgtgaacgtgcagtcgcagctcgtcgcattcgtcgacggcgcgggcacacataccgcgtggaaggtgagcggcaggccgcaggacagcctgcacggcgactgggagctgatcatcgacgcgggcagcggcgaagtgctgcgcgcgcaagacaaggcatcctacgcaacggacggcagcgggctcgtgttccggccggatccgttgtccccgacgaaaagcagctacggcagccccggcttcaaggacaacaacgatgcggactcgccgcaactgagcgccgcgcgcgtgcgcgtgacgctcaaggatctgacgcagacgagcggcggctacaagctgagcggcccgtatgcatcgtgcatcgatttcgatgcgccgctcgacaaggcgtgcccggttcaggcgtcgacgaccttcgatttcacacgctcgaacctctatttcgaggcggtgaacgcgtattaccacatcgacacgttcctgcgctacgtgaacctgacgctcggcatcaaggcgttgccgtaccagtacgcgggcggcgtccagtacgatccgcacggccaatccggcgacgataactcgtcgtactcgccgagctccggcaggttgtcgttcgggcaaggcggcgtcgacgacgcggaagacgcggatgtcgtgattcacgagctcggccacggcattcacgactggatcaccaacggcggactgtcgcaggtcgagggcctgtccgaaggcacgggcgactatctcgcggccgcatacagccgcgacttcaaccaatggagcccgtccgatgcgcagtatcactgggtcttcaactgggacggccacaacgaattctgggccggccgcgtcaccaattacaacgtcggccgcacgtacgcgcagatccgcaatgccgcgatccacaccgccggccagtactgggcgtcgtgcaacatggtcgcgcgcgatgcgatcggcggcgcggcgatggacaaggcgttcctgaaaggattgtcgatgacgaacggctcgacgaaccagaaggccgcggcgcaggcggtgctgaccgcggcggcggcgctcggctacagcagcgcgcagctcaatgcgatcggcgacgcgtacaacaagagctgcacgtacggcgtgaccgtgccgcagaagctgtaa

SEQ ID NO: 1093 - DNA, 1515 bp, Burkholderia pseudomallei
atggacgcatcgctgcgatcgcgctggcgcgccgtccaccggggcgcgggcgcgctgttcggcatcgtgctgttcgtgatcctgttcacgggcacgtggagtctcgcgcaggaatcgatgcagggctggtggcggccgccgtcgcttgccgtcgccgggccgccgctgccgctcgagcggctcgccgcgcgcgcggcgtcgctcggctttgcgctgcgcgacgcgcgcatcgtgctgccgcagccgaatgatccggcgatccggttctgcacggcgcggcacgcctgcctcctcgcgctgaacccggcgacgggcgagccgctcgcgcacgcggcgcgcgccgcgctgctcgtcacgctgcacaggacgatgttcaccggctttcccggccggatcttcgtgagcttatggggcgtcgtgctgctcgtgctgatcgccgccgggctcgtgttgcaccggcgccgctggcccgatgcggcgcgcgtgcggcgcgaccgcggcgcacgcatcgcgtgcttcgatctgcacggatggatcggcctctggggcgcgccgtggctcgtgctgttcgcgttcacgggcgcgctgtccgggctcggcgcgctcggcacggtatcgctcgcgccggcggcgttcccggggcagccgcaacgggtgttcgcgcagctgatgggcgcgccgccgcccgcggcggccggccggccatggtcacgcgcgccggatctcgacgcgctgctgcggcgcgacgccgcgcgcgcgccggcttttcgggccgaagtgctcgcgctgcatcactggggcgatgcgaacgcgagcgtcgaaatcgccggcacggcggcaggcttgccgagcacggcgctgttcgagcgccatctgtatcgtgcggccgacgggcagtggctcgcggacgccacgtcgcgcggccggggcgtctggctgcgtgcattcatcgcggttcagccgctgcatgtcgcgcgctacggctgggccggcacggcgggcggcggcctgcgcgcgcttcatttcctgatgggcgtggccgcttgcgtgctgtgcgcgacggggctcttgctgtggatcgaacgtcggcacgcgcacggcgacgcccgtgcccgcgcgctcgcggcactcggcgcgggcgtgtgcggcggcctcgtgctcgcgggcggcgtgctgctgttcgcggggcgcgtgctgccgcccggcgcgcgcgccgacaccgcgctcgccgcgctgttctggtcgacctggctcggcagcgcgctgctcgccgcgcgcgtgcgcgatcgcgcggcgctcgcgcgcgggttgatgggagcggcgggcgcggcgtatctgctcgccggcgcagcgcacctgtcgatcgcgctgctcgaggcgggcacgcccgtctacgggcacgtcgacgccgcgctcgccggcctcggcgcgctgctgctgcgtgcggcgcggcgtggccgccgcgtcgcgacgctgtccgccggcgtgccgccgccgcattccgaacttctttga

SEQ ID NO: 1094 - DNA, 396 bp, Burkholderia pseudomallei
gtgaataagccatatcgaacaatttggaatgcatcattgggcgcgtgggtcgctgcttcagtgattgctagaacatgcgggagacccggctcgaccaggacgatcttggtcgtaacggtcgcaatggtaggagcatctggagcgtatgcgcagtatgtcgctggtggtggttcgcaaactgaacagccgggtggaaagagggatatctcaaccagcgccaacgattctgctcttctctcgaatgcgcgaggaggggactcgggagcaaatggttcttctgctcgaggaaatgggactgcggatgagaacgggagggcgtatatcggcatgtcgaccttcctgggtcagaagacgatggcggctgacatgcaaggcccgtttcacggaaaaccttaa

SEQ ID NO: 1095 - DNA, 1203 bp, Burkholderia pseudomallei
atgaaaaagcgcactgcggtcgcgatgacggccgccggactggcggctgtcgccaccgcgcacgctcagagcagcgtgacgctttacggcatcgtcgataacggcatcgcgtatcaaagcagcagcacgtcgctcggctcgacgacgggcggccgctcggcggtgaagatgtcgacgggcgtgtgggcgggcagccgcttcggcctgaagggcagcgaggatctcggtggcggctcgaaggcgatcttccagctcgaatcgggcttcagcacggccaacggcacgtcgcagttcgcgggcggcatcttcacgcgccaggcgtgggtcggcctgaccaacccgacgtacggcacgctgacggcgggccgccagtacaccgcgtactacacgctgctgtcgccgtatagcccgacgacctggctcaccggctatttcggcgcgcatccgggtgacatcgattcgctcgataccagctaccgcacgaacaattcgctcgtctacctgtcgccgaagttctacggcttcacgttcggcggctcgtatgcgttcggcggacagccgggcagcgtgaacgccggctccacgtggagcgcgggcatccagtacatgaacggtccgctcggcatcgcggcggcgttccagcgcgtgaacaactcgacgtcgggcggcggcgactggggcgcgaattcgacgacgtcgaacggcggcgcgcagacggccgtgtcggcgatcaacaacggctacaagaccgcgcaggcgcagcagcgcgtcgcggtgacggccggctatcagttctcgtccgcatgggacatctcggtgtcgtactcgaacgtgcagtacatcccgggcgtgaactcgacgttccgcaacacggcgatcttcaacacggcgggcgcggtgctgcacttcaagccgtcggctcagtgggacttcgcgggcggctacgcgtacacgcgcgcgacccagtcgaacggcatcacgagcgccgcgcagtaccatcagttcacgctgtcgcagtactacagcctgtcgaagcgcacgggcctgtacgcggtcgaagcgtatcagcgcgcgaacggcaagacgctcgcgggcggcaagatcatcgacgcgaccgcgtcgatcggcgacggcttcaacacgtcgccgtcgtcgtcgcgcagccaggtgggcgtcggcgtcggcctgatccaccgtttctga

SEQ ID NO: 1096 - DNA, 1140 bp, Burkholderia pseudomallei
atgagacattcggcccgcctgctggcctgcggcgcgctctgcgtcaccgccgcgcatgcgcacgcgcaatcgagcgtcacgctatacggcatcgtcgacaccggcatcgaattcgtttcgcacgcgagcgcgaagggcggttccgcgtggcgcatgccggccgtcacgggcgagctgccgtcgcgctggggcttgcgcggcgtcgaggatctcggcggcggctatcgcgcgctcttcgcgctcgaaagcggcttcaacctgcgcggcggcgagctcggccagggcgggcgactgttcgggcgtcaggcatacgtgggcctgcgcgcgccgttcggcacgctcgcgttcggccggcaatacatgatgacttatgtcgcgctgcagggcgcggacatcatcggccccgacatctacgggctcggctcgctcgacgcttacatcccgaacggccgcgcggacaacgcggtgacctatgtcggcagctatcgcggcgtgacgctcggcgccggctattcgttcggccgcgactcggcaggcaccggcaattcgccggggcagggcacgtgcgtcggctcggtgccggggcgcgcggtcgaatgccggagcgggtcggcgatgctgaagtacgacgccgagcgcttcggcgtggccgcgtcgtacgaagagcagcgcggcggcgcgaacgcggcggcgaacttcttcgacggtgccgcgccgatgccgatcgcaagcagtgcggacaaggacacgcgcgcgcacgtgagcgcgtacgcgaacgcggggccggtcaagctcggcgcgggctggatcggccggcgcgtgtcgaccgacgcgcccgccgcgcccgacgtgcgcaccgatctgttcttcgtcggcgccgcctatcgcgcgacgccgttcgtgacgatcgacggcgaagcctaccggatcgtcgatgcgcggcacgacgcgcgcgcgacgatggcgacgctgcgcgcgagcttctcgctgtcgaagcgcaccgccgtctatgcgcagaccgcgtacctatggaacagcgcgcacgcgcgctattcggtgagcggcggcggaggcggcacgacgcccgcggccggcgtcggccagctcggcgcgatggtcggcgttcggcacatgttctga

SEQ ID NO: 1097 - DNA, 1725 bp, Burkholderia pseudomallei
atgcgattcatgcagatcatgcgccgggcgcgcatgctcgcgccgctcgcgttcgccgcgctgcaagcttgcggcggcgacggcgtcgatcccgcgctgccgcgccttgccgccgcggcgcccgccgcgatgtccggaacctgcggcgcgctcgccgcgaagctgcgctatccgcgtaccgcgttcacctcggtggcgactgcggcggccggcgcgctgagcgtcgcgggcaagccggtgggcgagcattgcgtgatcgcaggcaagatgaacgagcgcgtgagcgcgatcgacggcgagacttacgcgatcggcttcgagatgcggctgccgaaggcatggaacgggcgcttcttctatcaggcgaacggcgggctcgacggcgacgtcgtcgcggcgacgggcgacatcggcggcggcgggccgctcgacaacgcgctcaggatgggcttcgcggtgatcagctcggacgccgggcacagcgcggcgcagaacccgctgttcggcatcgatcccgatgcgcggctcgattatggctaccgcgcggtcgacgcgctgacgccgatggccaagcaggtgatccgcctcgcatacggcaaggcgccggaccgcagctatttcggcgggtgctcgaacggcgggcgtcatgcgatggtcgcggcggtgcgcaacgcgggcgactacgacggcatcgtcgcgggcgatccgggcttgcacctgccgaaggcggcgatcgccgaaatggccggcgcgcaacagttcgcgcgaatcgcgaccgcgaccgccgccgccggccggcccgacatccggagcggcttcaccgatacggagcgacggttcgtcgcgagccgcatactcgcgaagtgcgacgcgctcgacagcgtggcggacggactcgtcgaggacatcgccgcctgtcaggcgcgcttcgatctgaacgccgacgtgccgggctgcacgaatggcgtgcgcacgagccaatgcctgacgggcgcgcagaagacggcgctcgcgaacgtgttcgccggcgcgcgcaacagcgcgggcgaggcgctgtacgcgagctttccgttcgatgcgggcgtgagcggcgacaactgggccgcgtggaagcagggcaatgcgatgacgctcgaccccgcggcggcggcgttcacgttcacgacaccgccgcggcgcccgtcggcgctcgcggatctcggcgcctacgcgctcggcttcgacatggaccgcgacgcgccggcgatcttcgcgacgagcggcgtctatgcggcatccgcgtggtcgttcatgacgccgccggacgaagcggacctgtccgcgctcaagcgccgcggcggcaagctgatcgtctatcacggcacgagcgatccggtgttctcgtcgaccgatacgaccgactggtacgtgcgcgtgatgcaggcgaacggcggcgatgcgagcgacttcgcgcgcttttttcgcgtcgcggggatgaaccattgctcgggcgggcccgccgccgaccagttcgacatgctgacgccgcttgtcgcgtgggtcgaggccggcaaggcaccggacgcgatcgtcgcgaccgcgcgcgacgcgtcgaacgcggcacccaatcccgaggtgccggcgtcatggggcgcggcgcgcacgcggccgctgtgcccgtatccgcgcgtcgcgcgatacgacggcggcgacgtgaacgcggcggcgagcttcagctgccggtag

SEQ ID NO: 1098 - DNA, 4962 bp, Burkholderia pseudomallei
atgattccgcttgcaatagccgtggctctgatgttttcaccctacgcatgggcgggtgtcggcggagccgacaacggcgtgacggggacgagcaacaacggcggggtaggcggctcgtccggcggcggcggtgtccagttcagcgacatgggcgtggcctttgtcggcgatggcgactgctcgatgctcacgtccgggccgggatcgtatgccggcgtatacggttcggggagcaattatctgggcggcctgttcggcttcggcgcacagacgtcggccgtcggctgggggacgcccagcaacgccggcgccaacagcggtatcgtcccataccagggcgctgctcaaaccttcggcaacgtcacctatgccggcaacggcacgcagagcggcaacttcacgcaggcgttcggcctgaattcctttgcggtcggctgcggcgctcacgcgaccggcctgagcgcgacggcgatcggctggggaaccaccgcgagcggcgccggaagcgtcgcgctcgggctgtacagcaccgcgagcggccagggatcgttggcgttcggcaccagcgcgacggcgacggccaccgacaccatcgcgctcggcacgctggccacggccaacgcggtcagcggcgtggcgatcggcgcgaacacgcaggcttcggccgccaatgcaaccgcgatcggcggcaattcatccggcgccaacctcggcgcgcaggcgacggcggccggcgccactgcgatcggcggcaacgcgacggccggggccgccgcgacggcgacgaacgccatcgcgatcggcgggcagtcgtcggcgaaggatgcgaacgatgtggccgtgggcgtgggcgcgagggccggcacgggaagcggcgcgggcaacgatctcgcgatcggcaatggcgcgacggccacgggcggcaattcgatcgcccagggcgcgggcgcgagcgccaatgcggccggcgcggtggccatcggcaaatcggcgtccgccgccggcgggcaagccgtttcgatcggcgtggccaataccgcgtcgggcaacggcgcggtggcgatcggcgatccgaacgtcgcgaccggaaccggcgctgtcgcgctgggcaacaacaatacggccaatggtcaaggcgcggtggcgctgggcaacgtcagcacggcggtcggccaaggcagcgtggcgctcggcaacagcagcaatgcggccgcggcgggcggagtggccttgggcgataccgcgagcgcggtgatggcgggcggcttggcactcggctcgctcgcgacggcgagcaatgcgaacgacgtggcgctcggcgcgggttcgaaaaccgccgcggcagtcgcgacgtccacggtttcggtgaacggcgccaactacgcggtggcgggaagcggcccggccagcacggtcagcgtgggtgcgccgggcagcgagcgcacgatcaccaatgtggccgcgggtcaagtaagcgccggttccaccgatgcggtgaatggttcggaactgtacgcgacgaaccaggcaatcacgaccggattgtcgacagcgaacagcagcatcgcgtcgttgtccacgtcgacgtcgacgggtctttcgagcgccaacagcaacatcggctcgttgtcgacgggtttgtcgaccgccaacagcacggttgcgtcgctgtcgagttccacgtcgacggggctgtcctcggccaatagcgcggtggcgtcgctgtccacgtcgacgtcgacgggtctttcgagcgccaacagcaacatcggctcgttgtcgacgggtttgtcgaccgccaacagcacggttgcgtcgttgtcgacgtccacggttgccagcctgaattcgctgtccaccggattgagcacgaccaatagcaatgtcgcgtcgctgtcgagttccacgtcgacgggattgtcctcggccaatagcgcggtggcgtcactgtccacgtcgacgtcgacgggtctttcgagcgccaacagcaacatcggctcgttgtcgacgggtttgtcgaccacgaacagcacggttgcgtcgttgtcgacgtccacggttgccggcctgaattcgctgtccaccggattgagcacgaccaatagcaatgtcgcgtcgctgtcgagttccacgtcgacgggattgtcctcggccaatagcgcggtggcgtcgctgtccacgtcggcgtcgacgggtctttcgagcgccaacagcaacatcggctcgttgtcgacgggtttgtcgaccacgaacagcacggttgcgtcgttgtcgagctcgacgtcgaccggtatcggttcgttgtcgacgggggtggccaattctgtccagtatgacagtcctgctcatacgtccattaccctgggtggcgccagtgcaacgtcacccgtgaagatcactaatttggcggcgggcgcgaacccgagcgatgccgtcaactatgagcaactgacatcgctgtcgacgtcggcgtcgacgggactgtcgtcggccaacagcgcgatcacgtcgctatccacctcgacgtcgaccggcatcggttcgctgtccaccggactgagcacgaccaacagcaacgtcgcgtcgctgtcgacgtcggcgtcgacgggactgtcgtcggccaacagcgcgatcacgtcgctgtccacctcgacgtcgaccggcatcggctcgctgtccaccggactgagcacgaccaacagtaacgtcgcatcgctgtcgacgtcggcgtcgacgggactgtcgtcggccaacagcgcgatcacgtcgctgtccacctcgacgtcgaccggcatcggttcgctgtccaccgggttgagcacgaccaacagcaacgtcgcgtcgctgtcgacgtcggcgtcgacgggactgtcgtcggccaacagcgcgatcacatcgctatccacctcgacgtcgaccggcatcggttcgctgtccaccggactgagcacgaccaacagcaacgtcgcgtcgctgtcgacgtcggcgtcgacgggactgtcgtcggccatcagcgcgatcacgtcgctgtccacctcgacgtcgaccggtatcggctcgctgtccaccgggttgagcacgaccaacagcaacgtcgcgtcgctgtcgacgtcggcgtcgacgggactgtcgtcggccaacagcgcgatcacgtcgctgtccacctcgacgtcgaccggcatcggttcgctgtccaccgggttgagcacgaccaacagcaatctgagctccctgtccacgtcgagctcgaccggcctgagtacggccaacagcaacatctcgtcgctgtccaccgggctgaattcgttgtcgaccgcggtcaacggcggcgggacgaagtacttccacgccaactcgacgcagccggacagtcaggcgctgggggcggattccgtcgcggtcgggccggcggccatcgcggcgggcgcaagcggcattgcgatcggcaatgcggcgaacgcggccgcaaacggcgccgtcgcgatcggccaggccgccgtcgcgaagggcgggctggctgtctcgatcggggtgtcgaacacggcgagcggagacggcgcggtggcgatcggcgatccgaacgtcgcgaccggcaccggcgcggtcgcgcttggcgcggacaattcggcaaacggccagggcgccgtcgcgctcggcaacgcgaacatcgcaaccggaacgggctcgcttgcgttcggcaacacgtcgacggcggcagcggcgggcgcggtcgcgttgggcgccggcgcaatcgcgaacaatgcgaacgatgtcgcgctgggttccgctagcgtgaccgcggctgcgaatccggtggccagcgcgttgatcgcaggtcaggcttattcgcttgccggcggcgcgccggcgagcgtggtgagcgtcggcgcgcccggcgccgaacggcaaatcaccaacgtcgcggccgggcggatttccgccacgtcgaccgatgcggtgaacggctcgcagatgaatgcgatgactcaggcgctggaatcgctgtcgacttcgacggccagcgcgctgtccacggcgcaaagcggtctgggttcgttgtcgacggggctcagctcgacgcagagcagcgtgagttcgctgtcgacggggctcagcacgacgagcggcaatgtggcgtcgctgtcgagcggtctgggcacgatgcaaagcggtatcgcgtcgctgtccacggggctgagcacgacgaacagcagcctcgcgtcgctgtcgaccgccgtgtccggcggcggtgttcgcaccagcagcttgggcgacacgtcggcgggcaatggcgcgaacgcgtccggcggcaacggcacggcggtcggcggcgccgcgtccgcttcgggaaccgatgcgaccgcgctgggccaggcgtcgaacgcgtcgggcaatcattcgaccgcattggggcaagcatcgagcgcgtccggaagcggctccaccgcggtgggacaaggcgccggcgcgcccggcgacggcgcttcggcattcggccaaggggcacttgcctccggtacggactcgacggcgctcggcgctcattcgacggctgcggcgccgaattcggcggcgatcggcgcgaattcggtggcgtccgcgccgaattcggtgtcgttcggttcgcggggccatgagcgcaggctgacgaatgtcgcgccggggatcgacggcaccgacgcggcgaacatgaaccagctctggggcgtgcaatcgagcgtcgatcaggcggcgcgccgcgcctattccggggtggcggccgcgaccgcgctgacgatgattccggaggtcgaccccggcaagacgatcgcggtcgggatcggcgcgggcagctatcaagggtattcggcgtccgcgatcggcgtgtccgtgcggttctccgacaacctgaaggcgaagctcggcgtggggatcagcgctcagggcagcacatatggcgcaggcgtctcgtaccagtggtag

SEQ ID NO: 1099 - DNA, 840 bp, Burkholderia pseudomallei
atgagctacaagagcatcctggtccacctcgacacgagcgatcgcgcacgcgcgcggctcgagaccgcgctgacgctcgcgcgccagttcggcgcgtacctgagcgccgtcttcgccgtctacacccccgagccgacgtcgttctacgtgatggcgggcaccgccgactacttcgccgatcagcaaaggcggcgcgacgagaagcgcgcggcgctcgagcgcctgttccacgccgaactcaagcgcgcggacgtcgagggccagtggatcgtcgccgacgcgcgcgcgaacgaagcggtgccgcattacgcgcgctacgcggatctcgtgatcgccggccagaccgatccggacgatccggaaacctatgtcgacgacagcttccccgacacgctcgtgctgtcggccggccgcccggtgctgctgctgccgtacgcgggcatgccgtcggcgattggcacgcgcgtgctcgtcgcgtgggacggcagccgcgaggcgacgcgcgccgttcacgacgcggcgccgttcctcgcgctcgcgacgaagacgacgatcgtcaccgtgaacggcgccgcgcacgagccgcccggcgcgcgaattccgggcgccgacatcgcgctcacgctcgcgcggcatcacgcgaacatcgacgtgcgcgacctcgaacgcgcgcgcgacgcgtcgatcggcgacgtactgctgtcgcacgcgtacgaatcgggcaccgatctgctcgtgatgggcgcatacggccacgcgcgctggaaggagctgattctcggcggcgtgacgcgcacgatctttgcgtcgatgacggtgccggtgctgatgtcgcactga

SEQ ID NO: 1100 - DNA, 1125 bp, Burkholderia pseudomallei
atgaacaagactctgattgttgcagcagttgctgcatcgttcgcaaccgtcgctcacgcgcaaagcagcgtcacgctgtacggtgtgctcgacgcgggcatcacgtaccaaagcaacgtcgcgacgccgtcgggctcgggcaagtcgctgtggtcggtcggcgccggcgtcgaccaaagccgtttcggtctgcgcggctcggaagacctgggtggcggcctgaaggcgatcttcacgttggaaagcggcttcaacatcggtaacggccgcttcaacaacggtggcggcatgttcaaccgtcaagcgttcgtcggtctgtcgagcaactacggcaccgtcacgctgggccgtcagtacgacgcaacccaagactacctgtcgccgctgtcggcaacgggcacctggggcggcacgtacttcgcgcaccggctcaacaacgaccgcctgaacacgaacggcgacgtcgcggtgaacaacacggtcaagttcacgagcgcgaactacgccggcctgcaattcggcggcacgtactcgttctcgaacaactcgcaattcgcgaacaaccgtgcatacagcgcgggcgcttcgtaccagttccaaggcctgaaggtcggtgcggcgtactcgcaagctaacaacgctggcgcgaacaccacgggcgcaacggatccgctgaccggcttcaacatcggcggcacgaacgcagcaagcatccaaggccgttcgcgcgtgtacggcgccggcgcaagctacgcttacggcccgctgcaaggcggcctgctctggacgcaatcgcgtctcgacaacctggcaaacggcgcgccgaccacccgtgccgacaactacgaagcaaacgtgaagtacaacctgacgccggctctgggtctgggtgttgcttacacgtacacgaacgcgaaggcgaacggcgaaagcactcactggaaccaagttggcgtccaggccgactacgcgctgtcgaagcgcaccgacgtgtacgcacaagccgtgtaccagcgttcgtcgaagaacgcgaatgcgtcgatctacaacggcgacctcagcacgccgttcagcacgtcgatcaaccaaaccgcagcgacggttggtctgcgtcaccgcttctaa

SEQ ID NO: 1101 - DNA, 1089 bp, Burkholderia pseudomallei
atggtcaagcatgcggcagcaacattactcggcgcgctcgccgtcgccggcgcgtgggcgcagagcagcgtcacgctgtacggcagcctcgatgccggcgtcgcgtacgtgaacaacgtcggcggcggcgcgaagtggtcgatgattcagggcaacacgcagcccgatcgatgggggctgaagggcgtcgaggatctgggcggcggtctgaaggcgatcttccagctcgaaaacggcttctatacgaacaacggccagatggcggcggcgggcacgatgtggaaccgtcaggcgttcgtcggcctgaattccgaccggctcggcgcgctgacgctcggccaccagacgccgttcaacttcgactggctcgacccgctgtcgagcgcattcctcgcgcagagctggtatgcgttccatcccggcaacctcgaccagctcgcggacaccagcaccgtgccgttcaacaactcggtcaagtaccgctcgcccgcctttgcgggcttcacggtgggcgcgatgctcggcttcggcaacacgacgaacttctcgaccggccgcacgatgagcttcggcgtgaactacgcgaacggcccgttcaaggcggccgccgtctattcgaacgagcacgaccaggcgttcccgatggcgaccgtcggcggcatcgccgggccgggcggcacgttccagggcatgcccgtcgcgagctatgtcgcgaagaaggcgcagaacatgggcgcgggcctgtcgtaccgcttcggcccgctgctcgtgcacggcctttacacgcgcgtgaaactgcaggcgaacggccactcggatacgttccagagctacgacgccggcgcgaactaccagagctcgccgttcaacgtgatcgcgggcggcgcggcgacttcgacgctcgccggccgccgctggagccagttcgagctcggcgacacgtattcgctgtccaagcgcacgcagctctacgtgaacgtgctgtacgagcacgcgagcggcaacgcgaaggccgcgttcttcacggcgggcgcgtcgagcacggcgaatcaggtgattgtcctgacggggattcaccactcgttctga

SEQ ID NO: 1102 - DNA, 2316 bp, Burkholderia pseudomallei
atgtcgctggcggtgagcgcggcgatgggctgcatggcgaccgacgccgcggcgcaggtcagctatgcggcgggcgagaacgcctatgccggccccggcggcaataccggcccgtgggcgttctacaacccggccttcagcgcgggcacgctgctgtacggcaccgcggtcggcaactacgcctatgcgaacggcgagggcagctcggcctacggcgatcacgcgacggtgaaggggcgcatcggctccgcgttcggcgcgtattcggaagcggcgggcgacggcagcactgcaatcggcgccagcgcgcgggcgctgccggacttcagcatcgcgatcggcacgaacgcgcaggcgctgaaggacacgggccaatcgattcccggccgcgaagacatcggcacgatcgcgatcggcgcgggcgcgctcgcgcagggcgacaacagcgatccgctgcacgtgtccgcgccgaacgcgttcggcggctattcgagcgcgacggcaagcggcgcggtggcgctgggcgaaggcgccgcatcgtccggctattacgcgaacgcgctcggctcgtattcgaaggcgtcgggtgcgggtgcggtcgcggtgggcggcggcgcgcaagcgagcgcgcaaggcgcggtggcgatcggcggcgcgacgagcgtcgacaacgcaactgcgctgtccggctacgcgagcgcaagcggcgtcaacgcgatcgcgatcggttccggcgcgcaggcgacgggcgcccggtcgatcagcatcggcacgggcaacgtcgtgtcgggggcgagctcgggcgccttcggcgatccgtcgacggtcacgggcacgggctcgtattcgttcggcaacaacaacacgatcaattcgaacaacgcgttcgtgctcggcaacaacgtgacgatcggcccagggttcgacggctcggtcgcgctcggtagcggcacgacgctcgccgcggcgaaccccaccggcagcgcgacgatcacgacgagctcgggcggccagttgacgctgtccggcttcgccggcgcgaatccgacgagcgtcgtcagcgtcggcgcgcccggcgccgagcgccagatcacgaacgtcgcggcggggcgcatcacgccgacgtcgacggatgccgtcaacggcagccagctgtatgcggtcgcgagcacgatcgacaatgcggtgaacggcggcgggatcaagtacttccacgcgaattcgaccctggccgattcgacggcggcgggcacggacagcgtcgcggtcgggccggccgcgctcgcctacggcaacgattcgatcgccgaaggcacgaacgcgacggcgggcgtgagcggcaatccggcggtggcgggcgatgtcgcgctcggcagcggcgcgcaggcgacgggaggccgctcgctcgcgctcggcgcgaacgcgtcggtcaacacggcgggcggcgtggcgctcggcgccggctcggtcgcgaaccgcgcggccggcacgtacaccgatccgatcacgggcagcagcttcacgaccgcattcggcgcggtgtcggtcggcctcgagggttcgctgcgccagatcaccaacgtcgcggcgggcacgcaggcaacggatgcggtaaacgtcggtcagttgcaaggcgcgattgcgcagttgaatcagacgatccagaacatcacgaacggctccaactcgggcaacaccggcaataacggcaacaacaccgggcagaccgtgtcgggccagtggatcacgggcaacccgtcgacctatacgccgcccgtggcgagcggcatcggctcgaccgccgcgggcagcggcagcgtggcgtccggcgcgaacagcgtcgcgatcggcgacggcgcgtcggcctccggcaacaactcggtggcgctcggcgcccattcggtcgcgagcgcgccgaacacggtgtcggtcggctcggtcggcaacgagcggacgatctcgaacgtcgcgccgggcgtgaacggcaccgatgcggtgaacgtgaaccagttgaacagcggtatcggcaatgcggtcggccaggcgaatcagtacacggatcagaaggtcgaccatctgcggcgcgagatgaacggcggcgtggctgcggcgatggccgtggcgggcttgccgcagccgaccgcgcccggcaagagcatggtcgcgatcgccggctcgacgtggcaggggcagcagggcttcgcgcttggcgtatcgacgatttccgagaacggcaagtggctgtacaagggctcgctcacgaccagcacgcgcggcggcacgggcgcggtgctcggggccggttatcagtggtga

SEQ ID NO: 1103 - DNA, 954 bp, Burkholderia pseudomallei
atgacgacaccggttttcgacgcggctcagacggcgcgcgtcacgcctttcgccgaactcgtcgacgcgctgcgcacggcggcgctcgatgccgacgcgggctgtatcgagagcccggcgcggctcgtcgtgccgctcaacgaaggcggggtcatgctgtcgatgcccgcgtcggcggccgatctggcgatccacaagctcgtgaccgtatgcccgcgcaaccgcggcggcgatttgccgacgatccaggggcaggtgagcgtcgtcgatccggccacgggcgcgccgctcttcgcgctcgacgggccgaccgtcaccggccgccggacggccgccgtcacgctgctcgcgctgcgcacgtttgtcgccgccgcgccgcgcgacgtgttgctgatcggcaccggcacgcaggcggcgcatcacgtcgaggcgctcgccgcgctgtttcccggcgtgcgcgtgcgcgtgaaggcgcgtgcgcccgcgcaggcggcggcgttttgcgcgcgtctgcgggcggtgctgccgacgctcgagccgctcggcggcgacacgctgcccgagacgctcgacgcggtcatcacggcgacgacgagcgcgacgcccgtctacgacgacgcggcgcgagccgggcggctcgtcgtcggtgtcggcgcgtttacgcccggcgcggccgaagtcggcgcgcggacgatcgcgggcagcgcgctctacgtcgacgatccggcgggcgcgcgccacgaggcgggcgacctgatcgtcgcgggcgtcgactgggcgcgcgtgcgctcgcttgccgacgcgctgcgcgccaccgtgtcgacacccgcctccaacgcgtcgcccgcaccgggcgcgcccgtgttcttcaagagcgtcggctgcgcggcatgggatctcgccgcgtgccgcgtcgcacgcgcagtcacttcacgcactcgagcgtgtacttga

SEQ ID NO: 1104 - DNA, 1155 bp, Burkholderia pseudomallei
atgaaaaagcacgtcatttccgcagccgcattgctggccttcgccgcgccggttttcgcccaaagcagcgtcacgctgtacggcgtgatcgacgaaggcttcaactacacgagcaacgtgaacgtcaacggcgtcggcaagagcaactaccagctcgcgagcggtttcgtgcagggcagccgctggggcctgcgcggctcggaagacctgggcggcggcctgaaagccatcttcacgctcgaaaacggtttcgacgtgaacaacggccggctcggccagggcggccggatgttcggccgccaggcgttcgtcggcctgtcgcacgcgcaatacggctcgctcacgctcggccgccagtacgattcgctcgtcgactacctcgcgccgttgaccgcgaacggcaactggggcggcacgctgttctcgcatccgttcgacaacgacaacacggacaactcgttccgcgtgaacaacacggtcaagtacgcgagcccggactggaacggtctgcaagtcggcggcacgtacagcttcagcaacgcgacgggcttctcgaacaaccgccagtacagcatcggcgccgcgtacacgctgggcggcctgcaacttgcggccgcgtacctgcaggcgaacaacccgggcaagacggcgggcggcgcgatcgccgacaacgacgcgaacttcacggcggaccgcctgcgcatcttcggcggcggcgtcaactacacgttcggcccggcgacggtcggtttcgtctacacgaagaccgacgtgaagaacccggtctcgacggtctatctgccgacggcgacgttcgcgggcctcggcctgagcgcgacgaagttccagaacttcgaaatcaacggcaaataccagctgacgccggcgctcttcatcggcgcgcagtacgtgtacacggacggcaagttcgatgcggccgcgggcagcgtcaagccgaagtaccacacggtcggcctgatggcggactacaacctgtcgaagcgcaccgacgtctatctgcagggcgcgtaccagaaggtcgcgggcgacaagacgggcacgatcgcggatggcggctacgtcgtcgggacggacggcccctcggcgtcggcgaaccagttcgcggttcgcgcggcgatccgtcacaagttctga

SEQ ID NO: 1105 - DNA, 3396 bp, Burkholderia pseudomallei
atgctgatgacccgccacaaaaaacggaaaacgatgaagcgcagcggagcgaagctgcttgcgcccgtggtcgtcgcggccgccgccgcggtcgcggcccgccccggctgggcgcaggccgcgccgtacccggatccgggccggcgcggcgatccggcgagttggcgcacgccggaattcacgaacgcgtgggggctcggcgcgatgcacgccgagtatgcatacgcggccggctataccggcgcgaacgtcgcgatcggcgtgctggactccggctactacgcgcagcatccggaactacccgacagccgcttcgttccggtgacggccgcgggcgtgtccggcgtgctgaatccgaacaacaacaatcacggcacgctggtgagcggcgtcgtcggcggcgcgcgcgacggtgtcggcatgcacggcgtcgcacccgacgcgacggtgtacgaaggcaacacgaacgcgaccgacggcttccggttcggcgtatcggatccgaagtttcccgcgtcggatgcgaagtatttcgccgaggcctacgatgcgctcgccgcaaagggcgtgcggatcatcagcaacagctggggctcgcagccggccaacgagaactacagcaccctgaacaaactcaccgatgcctacaagctgcacgaggcggtgcgcacggcgaccggccggggcacgtggctcgacgcggcggcgaaggtgtcgcgtgacggcgtgatcaacaacttcagctcgggcaacaccggctacgacaacgcgagcctgcgcggcgcgtatgcgtacttccaccccgaactcgaagggcactggatgacgacgacgggctacgaccagttgagcggccaggtctacaaccaatgcgggatcgcgaagtggtggtgcgtgatggcgcccacgggcgtgccgtcgacgtcatattcgggcggcgcggcggcgccgaccggggcgacctacgcgaacttcaacggcacgtcggccgccgcgccgcacgcgtcggcggcgctcgcgctgatcatggagcgctttccgtacatgacgagcgagcaggcgctgtcggtgctgttcacgaccgcgcagaacatggagccggacccgagccggccggactacacgaacaacgggctgttctcgaccgtgcatccggcgaagcccggcgcgtcgggcgtgccgaacgcgttcggcggctgggggctcgtcgacctgcgccgggcgatgaacggcccgggccaactgctcggcacgttcgacgcggcgctgcctgcgggcaccgccgacgtgtggtcgaacgacatctccgacgtcgcgctcgccgcgcgcaagcgcgaggacgacgccgagcaccgcgcgtggctcgacacgctgaggacgaagggatgggagcacgggctgcccgccggcgcgagcgatggcgaccggatcgactatgcgctcggcgtcgcgcgcgaaaccgcgtatcaggcgcgcgagtatcagggcagtctcgtgaaatcgggcggcggcacgctgacgctcgccggcgcgaacacctatcgcgggcccacgacggtcgacggcggcgaattgaggatcgacggctcgatcgccgcgcgcgccgtcgtcaatccggcgggctggctcacggtgaacggccgcgcggccgacatcgcggtcaacggcggcgtggcgacgatcgccgggacgagcgcgaacctgtcgatcgacaggcagggccgggccgccgtgacagggacgacggcggacgtgcgcgtcgcgagcggctttgcatcgctcggcggcacgagcggcagcgtcgcggtgggggcgctcggcgtcgccgcgatcacgggccgcacggccgacgtggcggtcgacggcggccgcgcgtcgctcgacggcgcgagcggcaacgtcgcggtcggcaacggcggcgtcgtgagcggcagcggcacggtgcgcacgctcacggccgccgcgaacggcacggtcgcgcccggccattcggtcggtacgctgacggtgtcgggcgacgtgcgcttcgcgccgggttcgatctacgcggtcgaggtgtcgccgggcggcgcgggcgaccggatcgtcgcgggcggccgcgcgcaaatcgacggcggcgcgttggcgctcgcgctcgagaacacgccgccgccgctcacgcccgagcagtcgcgctcggtgctcggccgtcgcttcgagatcctgaatgcggcgggcggcgtggccggccgtttcgatgcgccgagcggctatctgttcgtcaatccggtgctcgcctatggcccgacgaccgtgagcctcacgatcgatcgtaacgcgacgccgttcgcaagcgtcgcgcggaccgcgaacgagcgcggcgtcgccgatgcgctcgaaacggcggacccgggcagcgcggtttacaacagcgtgctgttcgcggcgtccgcgcaggcgccgcaggcgacgctcgcgcaactgacgggcgagatctatccggccgcctacgcggcgctcgtcaacgaaagccggcaagtgcgcgaagcggcgctcgagcgcctgtggacggcgcgcggcgcgccgggccgcgccggcgcctgggcgcggctgctcggcgcgtggggcagcgcgcgcggcggcgacgtgaacggctacacgagctcgacgggcggcttcctcgcgggcgcggacgcggcgttgctcgacggcgtgcgggcgggcggcttcgccggctacagccacaccggcgtgaacctgaggaatcagccgtcgtccgcgtcgttcgacagcttccatctcggcgcatacgcggggtggcagcccggcgcactcggcgtgcgaatcggcgcggcgcatgcgtggcatcgcggcggcgtcgatcgcgcggtgcaatatggcgcggttgccgagaacgaaacgacggcgctgcacgcggaaacgacgcaggtgttcggcgaggccggctatcggttcgcgctcgatggcgccgcgacgctcgagccgttcttcggcgtcgcgtatgtgcatctgaagaaccaggggacgacggaaaccggcggcgcggcggcgttgcgcgtgcggcaaggcaatcacgacgtgacgttctcgacgctcggcgtgcgcggcgaaacgcggcttggcctgacgtcgcgactgcagttgacgctgcagggcagcgcgggctggcagcatgcgctgacggacgggcagccgagcggcacgctcgcgttcgcgacggggagcgacacgttcatcgtgtcgagcgtgccggttgcgaaggatgcggcggtgctgaacgtgggcgccgggctcgagctcggcaagaacggatggctgcgcgtcggctattccggctcgctcgcgagccgtcagtccgagcacgcggtgcaaggcagcctgcactggaagttctga

SEQ ID NO: 1106 - DNA, 252 bp, Burkholderia pseudomallei
atggcccgccccctgtaccgcattcgtcagttcgcgcagtcccgcgtgcgcggcgggaagctgttctgcgtcggcgcgtgccaggtgcagcagcgcgtcgctggcctgttctggcttgagattgcctattgctcggatcgcaccggcgcggaggcggccatacgagccgccgtgatcgcgcgccggcgagcccggctcaagccgcgcgtgctcggcctgttcgatcgcgacgggcaggcgctcgggcaatga

SEQ ID NO: 1107 - DNA, 264 bp, Burkholderia pseudomallei
atggtctcttcccattcacactgtgaggtgattgacatgctttacgacgacatcgtttccgcattaggcaaagcagttaaagatcccggctatcgcgacaaactcctgaaggatccgaacggcacgctgaaggccgagggcgccgatctcggaaattcggtcaccaccctcgaatgggtcgaatcgaccaactgcctgaatgttcacgtcgcgaacggcggcgcgaactggagcggcgcggtgctgctcaagatcgagaagtaa

SEQ ID NO: 1108 - DNA, 423 bp, Burkholderia pseudomallei
atgagcttattgttcgccttcttgtcgggcttgctgttcggcgccgggttgctgctgtccgggatggcgaatcccgcgaaagtgcagggctttctcgatctcgccggcaattgggatccgtcgctcgcgttcgtgatggcgggggcgatcgcggtcggctcgatcgcgttcgcgttcgccaagcggcgcgagcgctcgttgctcgggctgccgatgcagattccgccgcgcggagccgtcacgccgcgactcgtcgccggcagcgcggcattcggcgtcggctgggggctcgtcggcttttgtccggggccggccgtcgtgtcgcttggcctcggcggcgcgaaggcgttcggcttcgtcgcggcgatgctgatcgggatggcggcgttcgaatgcggcgagcgtttcagggcgaaacgttga

SEQ ID NO: 1109 - DNA, 1017 bp, Burkholderia pseudomallei
gtgacgccgacgatgatgccgcccgacacgcccacgcccgccggcgcgccgccgaacgcgaccactgccgacgatgcgttgcgcgacgtcgcgccgcaaacgggcgcgcgcgcgctcggcgcggcggccgcgcgcgcgcagccgcgcacgcgcgagctgcggatcgccacctacaacattcacggcggcctgggcgcgtggacggcgagcgccgccgagcggatcgcggtggtgctcgacgaactgcgcgccgacgtgatcgcgctgcaggaagtgccgctcggcggcgcgcgcggagccgacgtgctcgcgcacttgcgcgcgtgcaccggcatgcatgcggcagaagggccgacgatcgatacccccgcgcgccgctacggcaacgcggtgctgtcgcgctttccgatccgcgcggcgcgcatgctcgatctgtcgttcggcaaccgcgagccgcgcggcgcgctcgacgcggacatcgaatgcgggttcggcgtgctgcgcgtcgtcgcgacgcatctcgggctgtcggcgaccgagcgcagcgcgcaggtcgcgcggctgctcgccgcgttcgacacgcgcgcgctgcccgtgatcctgctcggcgacatcaacgaatggttcgtccgcggccgcgcgctgcgcgcgctcgtcacgcatttccggcgcgcgcccgcgccgcgtacgttcccgacgctgtgcccgctgttctcgctcgaccggatctgggtgcacccgggcgaatggctcgtcgacgtggcgccccatcgcagcgcccgcgcgcgccgcgcgtccgatcactacccgctcgtcgcgcgcattcgcgcagccccagaaacagacgcggacatcgcgcaagcgccggcgtccgcttcgcgcacgccaccggagcgaccatgcgaaccgaccgactcgacggaacccgcctcgactactggtgcgcccgcgcgctcgccggcgacgacgccacgctgcgcttcgtcgccgtcgcgccgagcgtcgtcgtcaccgtga

SEQ ID NO: 1110 - DNA, 1350 bp, Burkholderia pseudomallei
atgagcgcggacgagcccttgcgcacggccgaattcagccacctggcggatgcgatcgagcgggaaattctcgcggtgtcgggtgtcgtgcgcacgggccgggtcctcgaagtgatcggcacgctgatcaaggtgtccgggctcgacgtcgcgctgggggaattgtgcgagcttcgaacgcgcgaaggcaggctgttgcaacgggcggaagtcgtcggtttcacgcgtgatgtggcgctgctgtcgccgttctcgcaactcgagcagatctcgcggaccacccaggtgatcgggctcggccgtccgttgtcgatcccggtcggcgacgcactgctcggccgcgtgatcgacggcctcggagagccgctcgacggcggtccgccgcttgcgtcggaaacgctgcagccgctgatcgcggcgcctcccgagccgatgagccgtcggatgatcgatgcggcgatgccgacgggcgtgcgagtcgtcgacgcgatgatggcgctcggggagggccagcgcatgggtatcttcgcgccggcgggggtcggcaagagcacgctgctgggcatgttcgcgcgcggcgccgcgtgcgatgtcaacgttatcgcgctgatcggcgagcgggggcgcgaggtgcgggaattcatcgaactgattctcgggcaggcgggcatggcgcgttccgtcgtcgtctgcgcgacgtcggatcgttcgtcaatggagcgggcgaaggcggcctatgcggcgacggcgatcgccgaatactttcgggaccgcggccgacgcgtgctgttgatgatggactcgttgacgcgcttcgcgcgagccgggcgcgaaatcggcctcgcggccggcgagccgcctgccaggcgaggctttcctccgtcggtcttcgccgaattgccgcgcttgctcgaacgcgccggaatggggaggaccggatcgatcaccgcgctctataccgtactcgcggaagacgagagcggcagtgatcctgttgcggaagaagtacgcggcattcttgacgggcacatgatcctgtcgcgggaagtggcggcgaaaaatcagtatccggcgatcgacgtattggggagcctgtcccgcgtgatgccgctcgttgtcgacgatgggcatatgcgagcggcggcgcgggttcgggaattgttggccaaacatcgggaggtggaggtcttgctgcagatcggggagtacaaggcgggggcgaatccgcttgcggacgaggcgatcgcgaaggccgacgcgattcgatcttttttttcgcaacgaacggacgattacgcggccgccgaggacaccgtcgccaggctgtatgcgttgagcggggcgaactga

SEQ ID NO: 1111 - DNA, 2118 bp, Burkholderia pseudomallei
atgttcaaatcgctgaaactgcccgcgggcggtgaaatcggaatcgtcgccctggtcatcgcgatcatctcgctgatgatactgccgctgccgccagtcgcgatcgacctgctgctgggcatcaacatcaccatcagcgtgacgctgctgatggtgacgatgtacgttccggatatcgccgcgctatccgcgtttccgtcgctcctgctgttcacgacgctgttccggctgtcgctcaacatcgcgtccaccaagtcgatcctgctgcatgcggaagcgggcaacattatcgagagctttggccagctggtggtgggcggcaacctcgtcgtgggcctggtcgtattcgccatcatcacgaccgtgcaattcatcgtgatcgcgaaaggctccgagcgtgttgcggaagtcggcgcccgcttcacgctggatgcgcttccgggcaagcagatgagcatcgacgccgatttgcgctccggcctgctgagcaccgaggaggcacggaagaagcgcgcgacgctggcggtcgaaagccagttgcacggcgggatggatggcgcgatgaaattcgtcaagggcgacgcgatcgccggtctcatcatcacgatgatcaacatcgtcgcgggcattgcggtcggcgttgcatatcacggaatgtcggcgggcgacgcggcaaaccgcttctccgtattgtccgtcggcgacgcgatggtgtcgcagattccgtccctgttgctctccgtcgcggcaggcgtgatgatcacgcgcgtcaccgacgagcgcgcgccgaagcggcgctcgctcggcgatgaaatcagccaccagctcggctcgagcgcgcgtgcattgtatttcgcagcgtttcttctgctcggcttcgccgccgtgccgggcttccccgcggcgctgttcgtgctgcttgccgccgcgctcgcgttcgccggctatcgactgtcacgaaagggttcgccatcgtccggcgccgctcgcggacaagagcaggaggcgctgcgtgcgatgcagcgttcgggcgccaaggcggacgtccctccgatcctgccgcgcgcgcctcagttcgcttgcgccgtcggcgttcggatcgcgccggatctcgcgtccggtcttgcgttgccgaggctcgacgaagcgctcgacctcgagcgtgcacgcctgcaggacgaactcgggcttccttttcccggcgtgacgatgtggattcatccgacgctctcggcagcaaccttcgaagtgctgatccacgacgtgccgcatctttccgtcacgcttccggctcgcaaggcgatgctgccgcagcaaaggcatctgtcgcccgctcacgccgcgctgacggacgagcaaaaggcgcggcaccgggatttgatcgaacggagcgaagccggcccgccgatcgacgcaagcggccaagcgacccactggatcgacgagccggcggtcaccgcgaaggacagcgtatggcgcgcagaacagatcatcgcgtacgcatccgtggcggcgatccgcactcacgcaccgctttttgtcggcatccaggaagtgcagtggatactcgatcagttgggcgccgactccccgggcctcgtcgccgaagtgctgaagatcttgccgtcgacgcgcattgccgatgtgctacgccgcctgcttgaagagcagatatcgatccgcaacgtgcgaacgatcatggaaagtctggtcgcatggggcgcgaaggagaaagacatgctgatgttgaccgaatacgtgcgcggcgacctgtcgcgctttctcgcccatcgagccgcgcaaggcgaacgcgtgttgtccgcggtcctgttcgacctgcaggcggaacagcacatccgccaggcgatcaagcaaacgccgacaggcaatttcctcgcactgcccccggacgacgcatcgcggcttgtcgatcgcattcagtcgctcgtcggcgcgaacgcccgcacggacatcgcgctcgtcacctcgatggacattcgccgctatgtacgacgaatgatcgagcgacgcatcgactggctagccgtgtactcgtatcaagagctcggcgaacacgtcgagctgcgtccggtcggccgcgtgtcgctccagggttga

SEQ ID NO: 1112 - DNA, 960 bp, Burkholderia pseudomallei
atgcctgcacgaaaatcctccgaggaggcttgcgtgaatcgctcatttcgttcttccaatcatttgtcctcgccggcccagctgcaacagtccgcagatgcgcagcagcgcaccgccgaccgtcaggcggcgcgcaacagcgcgctgaccgcggcgctgtatcgcggcacgacgaatttcacctacagcaaagatcctgcgccacgcggcaggctgccgagcgtctccaagacgaatgcccttgcgcgaaagcgcaagatcacgagccggctgcgtcgaaacgccgccggcaacggcgatggcgatggcgacgacgttgacggcgcgctcgtgcctcacttcgaagccgaaccgggcggggaccgcgatcgcgatgggcgtgggggacgggagcagccgcgcgacgatcctatggatatcgaaacttgcaggcggcttcctcgcatgcaggcggccgaatcgcgcgccgcggctgccccacgcggccgcttcgatgcggtcgccgatctgcatgcggcccccggtcaggaaggcgagcgcgccgacgcgattgcccgggcctgggagagcgagatgttcggactccaagtatttccccccaatgcgccacgcacggcggagattctcgaattgtcgttggactttcttctcatccagcgacgcatcgggccgattcccgttagtacgctcgccaggctgcgcgagtctcctgctcccacgccggttgcttgcggccgagatcgcctgcctggcgagacggcgccggacgacagacggcgcttcaatctgctctttccgttgctgtggttgcaggcgggcatgccgagaacggccgtccgcctcgattgcgcgatcgccaagctgctcgcgatccgcaacgcgctgcctgacaatccgctagcaacagatgacgcgcaagcggaaccgacaccggcacctcacgcctcatcgagcgaatga

SEQ ID NO: 1113 - DNA, 7905 bp, Burkholderia pseudomallei
atgaatcgctcgtaccgctctatctggaatgaagcacttggcgcgtgggtcgccgcttcggaaatctcgtccgcccgcggcaagccgaacaagtcggccgtcgcgaaggtcgtgaccgccgccgtgctggccgtggtcgtgcaggcagcgcatgcaagcacgatcggcgtcggaactggctcgcttccgggggggtccgcgtgcggcggcattggcggaacaggaataggtcctgacggtacgacgaactatacgaaccgggcgatcaccgacggcagcggattctactcaaccgttgccgggtgctcggccaacggcagtaatgccctgggcgtgacgctctatggcgcattcacgaccgtcaccggagacggtggcacggccatgggcttcgccgcttacgccgcaaagtgggcgtcggccgttggccttcaggcgtccgcgactggccagtccagctcggcattcggattcaatgcgctggcgagcggcgccaactcgcttgcactcggctcgtcgagcaccgcggcgtacgcgaacagcgtcgcgatcggccaaggcagcgtcacgggagcggcggccccgacggggaccggctatttgacgggcagcgccgccccgtcttcggaggtgtccgtcggttcctcgaccaatttgcgccgcatcaccaacgttgcggacggctccgcagcgaatgacgccgtcacggttgcccaactgagtacgggcatgagcacgaccactagcgcaatcgccagtttgtcgacctccacatcgaccgggctttcgtcagccagaagctcgatcgcgtcgctgtccacgtcgacttcgaccggcctgagctcggccaccagctcgatcgcttcactgtcgacttccacgtcgaccggcatcggttcgctttccaccgggctgtcgaccaccaacagcaacgtcgcctcgctgtccagcggcctgagcagcacgaacagctcgctgacctcgctgtcgacttccgcctcgtcgggcatcagcaccgcgcagagcggtgtcaattcgttgtccaccgggctgtcgaccaccaatagcaacgtcgcttcgctgtccacgtcgacttcgaccggcttgagctcggcgaatagctcgatcgcctcgctttcgacttccgcttcgtcgggcatcagcaccgcgcagagcggcgtcaattcgttgtccaccgggctgtcgaccaccaatagcaacgtcgcttcgctgtccacctcgacctcgaccggcctgagctcggccaccagctcgatcgcttcgctgtcgacttccacgtcaaccggtatcggctcgctttccaccggcctgtcgaccaccaacagcaacgtcgcctcgctgtccagcggcctgagcagcacgaacagctcgctgacctcgctgtcgacgtccgcttcgtcgggcatcagcaccgcgcagagcggtgtcaactcgttgtccaccgggctgtcgaccgcgaatagcaccgtcgcttcgctgtccacctcgacttcgaccggcctgagctcggccaccagctcgatcgcttcgctgtcgacttccacgtcgaccggtatcggctcgctttccaccggcctgtcgaccaccaacagcaacgtcgcctcgctgtccagcggcctgagcagcacgaatagctcgctgacctcgctgtcgacttccgcctcgtcgggcatcagcaccgcgcagagcggcgtcaattcgttgtccaccgggctgtcgaccgcgaatagcaccgtcgcttcgctgtccacctcgacgtcgaccggcctgagctcggccaccagctcgatcgcttcgctgtcgacttccacgtcgaccggtattggctcgctctccaccggcctgtccacgaccaacagcaacgtcgcctcgctgtccagcggcctgagcagcacgaatagctcgctgacctcgctgtcgacttccgcctcgtctggcatcagcaccgcgcagagcggcgtcaattcgttgtccaccgggctgtcgaccaccaatagcaccgtcgcttcgctgtccacgtcgacttcgaccggcctgagctcggccaccagctcgatcgcttcgctgtcgacttccacgtcgaccggcatcggctcgctctccaccggtctgtccacgaccgatagcaccgtcgcttcgctgtccacgtcgacctcgaccggcctgagttcggccaccagctcgatcgcttcgctgtcgacttccacgtcgaccggtatcggctcgctttccaccggcctgtcgaccaccaacagcaacgtcgcgtcgctgtccagcggcctgagcagcacgaatagctcgctgacctcgctgtcgacgtccgcttcgtcgggcatcagcaccgcgcagagcggcgtcaattcgttgtccaccgggctgtcgaccaccaatagcaccgtcgcttcgctgtccacgtcgacttcgaccggcctgagctcggccaccagctcgatcgcttcgctgtcgacttccacgtcaaccggtattggctcgctctccaccggcctgtccacgaccaacagcaacgtcgcctcgctgtccagcggcctgtcgacgaccaatagcaacgtcgcgtcgctgtccagcggcctgagcagcacgaatagctcgctgacctcgctgtcgacgtccgcttcgtcgggcatcagcaccgcgcagagcggcgtcaattcgttgtccaccgggctgtcgaccaccaatagcaccgtcgcttcgctgtccacgtcgacttcgaccggcctgagctcggccaccagctcgatcgcttcgctgtcgacttccacgtcaaccggtattggctcgctctccaccggcctgtccacgaccaacagcaacgtcgcctcgctgtccagcggcctgtcgacgaccaatagcaacgtcgcgtcgctgtccagcggactgagcagcacgaatagctcgctgacctcgctgtcgacgtccgcttcgtcgggcatcagcaccgcgcagagcggtgtcaactcgttgtccaccgggctgtcgaccgcgaatagcaccgtcgcttcgctgtccacctcgacctcgaccggcctgagctcggccaccagctcgatcgcttcgctgtcgacttccacgtcgaccggtatcggctcgctttccaccggcctgtcgaccgtcgcgacgacgaccaacaatctcggcagcagcaccgccgcggcgctcggcggcggcgcgacgtacaatccggccaccggcacgatttccgcgccgtcgtacacgacgtacaacgcgaacggcacgaccacggccaacaccagtgtcggctctgcgatcgacagcatcaacgcgaacggcatcaagtacttccatgcgaactcggcggggccggacagcgtcgcgaccggcgcggacgccgtcgcgatcggcacgggcgcgacggccgccacggcgaactcggtcgcgctcggcgcgaactcggtgacggccgcggccgtcccgaccagcagcgcgaccgtcggctcgaccacgctcggtacgttcgcgggcagcgcgcccgtgggcgtcgtgagcgtcggggcgccgggcgcggaacgccagatcacgaacgtcgccgccggccaggtcaccgccagcagcaccgatgcgatcaacggcagccagctctatgcggttgcgtcgaagctcgactcggcctcgagttcgatttcgtcgctgtcgacgggactgtcgtcggccaccagttcgattacttcgctctccacttccacctcgacgggcctgagctcggcgaatagctcgatcgcctcgctgtcgacctccacgtcgaccggtatcggttcgctctccaccggtctgtccacgaccgatagcaccgttgcctcgctgtccacctcgacctcgaccggtctgagctcggcgaatagctcgatcgcctcgttgtcgacctccacgtcgaccggcatcggctcgctctccaccggtctgtccacgaccgatagcaccgtcgcttcgctgtccacctcgacctcgaccggcttgagctcggccaccagctcgatcgcttcgctgtcgacctccacgtcgaccggcatcggctcgctgtccaccggcctgtccacgaccaacagcaacgtcgcttcgctgtccacctcgacttcgaccggcttgagctcggccaccagctcgatcacctcgctgtcgacctccacgtcgaccggcatcggctcgctttccaccggcctgtccacgaccaacagcaacgtcgcctcgctctccagcggcctgagcagcacgaatagctcgctgacctcgctgtcgacgtccgcttcgtcgggcatcagcaccgcgcagagcggcgtcaattcgttgtccaccgggctgtcgaccgcgaatagcaccgtcgcttcgctgtccacgtcgacttcgacgggcctgagctcggcgaacagctcgatcgcttcgctgtcgacttccacgtcgaccggcatcggctcgctttccaccggcctgtccacgaccgatagcaacgtcgcctcgctctccacgtcgacttcgaccggtctgagctcggcgaatagctcgatcgcctcgctgtcgacttccacgtcgaccggcatcggttcgctgtccaccggtctgtccacgaccgatagcaccgttgcttcgctatccacctcgacttcgaccggcctgagctcggcgaatagctcgatcgcttcgctgtcgacctccacgtcgaccggcatcggttcgctttccaccggcctgtccacgaccaacagcaacgtcgcttcgctgtccacgtcgacttcgaccggtctgagctcggccaccagctcgatcgcctcgctgtcgacctccacgtcgaccggcatcggctcgctgtccaccggcctgtccacgaccaacagcaacgtcgcttcgctgtccagcggcctgagcagcacgaacagctcgctgacctcgctttcgacttcagcttcgtccggcatcagcaccgcgcagagcggtgtcaattcgttgtccaccgggctgtcgaccaccaatagcaccgtcgcttcgctgtccacctcgacctcgaccggcttgagctcggccaccagctcgatcgcttcgctgtcgacctccacgtcgaccggtatcggctcgctttccaccggcctgtcgacgaccaacagcaacgtcgcttcgctgtccacctcgacttcgacgggcctgagctcggccaccagctcgatcgcttcgctgtcgacctccacgtcgaccggtatcggctcgctttccaccggcctgtcgacgaccaacagcaacgtcgcttcgctgtccacctcgacttcgacgggcctgagctcggccaccagctcgatcgcttcgctgtcgacttccacgtcgaccggcatcggctcgctgtccaccggtctgtccacgaccgatagcaccgttgcttcgctgtccacgtcgacttcgaccggtctgagctcggccaccagctcgatcgcttcgctgtcgacctccacgtcgaccggtatcggctcgctttccaccggcctgtccacgaccgatagcaccgtcgcttcgctgtccacgtcgacttcgaccggcctgagctcggccaccagctcgatcgcttcgctgtcgacttccacgtcaaccggtattggctcgctctccaccggtctgtccacgaccaacagcaacgtcgcttcgctgtccacctcgacttcgacgggcctgagctcgaccaccagctcgatcgcctcgctgtcgacctccacgtcgaccggtatcggctcgctgtccaccggcctgtccacgaccgatagcaccgtcgcttcgctgtccacctcgacttcgaccggcttgagctcggccaccagctcgatcgcttcgctgtcgacctccacgtcgaccggcatcggctcgctctccaccggcctgtccacgaccaacagcaacgtcgcctcgctgtccagcggcctgagcagcacgaacagctcgctgacctcgctgtcgacttcagcttcgtccggcatcagcaccgcgcagagcggtgtcaattcgttgtccaccgggctgtcgaccaccaatagcaccgtcgcctcgctgtccacgtcgacctcgacgggcctgagctcggcgaatagctcgatcgcctcgctgtcgacctccacgtcaaccggcatcggctcgctctccaccggcctgtccacgaccaacagcaccgtcgcgtcgctgtccacgtcgacttcgaccagcatcggttcgctgtccaccggcctgtcgtcgaccaacagcaacctcgtgtcgctctccacgtccgcctcgaccggcatcggctcgctgtcgaccagcatcgacacgaccaacagcaacctcgcgtcgctctccacgtccgcctcgaccggcatcggctcgctgtcgaccagcatcaacgcgaccaacagcaacctcgcgtcgctctccacgtccgcctcgaccggcatcggctcgctgtcgacgagcatcagctcgatcacgacgaacacgacgaacctcggcaacagcaccgccgcggcgctcggcggcggcgcgacgtacgatccggccaccggcgcgatctccgcgccgtcgtacacgacgtacaacgcgaacggcaccaccgcgaccaacaccagcgtcggcgccgcgatcgacaacatcaacgcgaacggcatcaagtacttccacgcgaactcgaccgatccggacagcgtcgcgaccggcacgaacagcgtcgcgatcggcccgaacgcggtcgcgaacgtcgactactcggtcgcgatcggcagcggcgcgacgacctcggcggccgtgcccgtcgcgtcggcgagcgtcggcggcctcacgttcggcggcttcgcgggcagcgcgcccatcggcgtgttcagcgtcggcgcgccgggcgcggaacgccagatcacgaatgtcgccgccggccgcatctccgcggccagcaccgacgccgtcaacggcagccagctctacgcgaccaacagcaatgtcgcgtcgctgtcgaccggtctgaacgcgacgaacagcaacctcgcgtcgctgtccacgtccacctcgaccgccgtcggctcgctgtccaccggcctgtccacgaccaacagcaccgtcgcctcgctgtccacgtcgacctcgaccagcatcggctcgctgtccaccggcctctcgaccgcgaacagcaacctcgcgtcgctgtccacgtccacctcgaccggcatcggctcgctgtccaccggcctcgcgacgaccaacagcaatgtcgcgtcgctgtcgacgagcgtgaccaacatcaacacgcagctcacgtcgctgtcgacgtcgatcacgaacaacgtgatccggtcgctgcccgcgagcaccggcgtcgccgcggacatgagcgcgccgaaggcgacctcgccgtccgtcacggccggctcgaactcggtcgcgctcggcgcgggctcgaacgacggcggtcgctcgaacgtcgtgtcggtgggcagcgacacgcagcagcgccagatcacgaacgtcgcggccggcaccgagggcaccgacgcggtcaacgtcaaccagttgaatacgctgtcgacgtcgatgtcgcaatcgctgtcgaatcagcaaacgcagctcaacaatctcggctcgcaactgaaccagacgcagcagcaactgcagcagaccgacacgatggcccgccaggggatcgcggcggtcgcggcgatggcgtcgattccgcacatggaccgcgactcgaacttcgcgatgggcgtgggcacctcttcgttcctcggccagaaggcgatcgcggtcggcatgcaggcgcgcatcaccgagaacctgaaggcgtcgctgaacggcggcttcgccggcaatcagaaggtcatcggcgcgggcatgctctatcagtggaagtaa

SEQ ID NO: 1114 - DNA, 4593 bp, Burkholderia pseudomallei
atgaacaagatctataaaaccatctggtgcgagaccacgcggagctgggtcgcggtttccgagcacgcaaacggcaagcgcggcggcgcgacggcggccgcgacgacttccgcgcgtccgatctggacgcggctgcgcggcatctcgctcgccgcgctggcagcgttcggcctggggctcttcgcctcgcccgccgcgttcgcgcagtcgaattcggtgatgtgcgcgaactacaacaacggcattcttccgacctataccggttacggcgcgagcccttcgctcacctcgccctgcacgacgggcatcggctcgtgggcgggcggcgtcacgcccggctcgacgaccaactggatcggcctgtccgccgacgacacgcaaatcgtcctgaacggcagcaccggcaatatctatttccgcgcgggcggcacgaacggcaacacgctgacgatgagcaacgtcgcgggctcgggcccgacgggaggcgtgctgctgtcgggcgtcgcggcgggcgccgtgacggcgacgagctcgcaggcgatcaacggcagccagctctattcgctgtcgacctcggcatcgacgggcatcggctcgttgtcgagcagcatgtcgacgttcaacagctcgatctcgtcgctgtccaccggactgtcgtcgacaaacagcggcctgacctcgctttccacttcggcgtcgacgggcctgtcgtcggcgaacagctcgattgcttcgctgtcgagcgggctgagcagcacgaacagctcgctgacctcgctttcgacgtccgcttcctcgggcatcagcaccgcgcagagcggcgtcaattcgctgtcgaccggactgtcgacgaccaatagcacggtcgcttcgttgtccacgtcgacctcgaccggcatcggctcgctttccactggcctgagcagcacgaacagttcgttgacctcgctttcaacgtccgcctcgtcgggcatcagctcggccaatagctcggttgcttcgctgtccacgtcgacctcgaccggcatcggctcgctttccaccggcctgagcagcaccaacagctcgctgacctcgctttcgacgtccgcttcctcgggcatcagcaccgcgcagagcggcgtcaattcgctgtcgaccggactgtcgacgaccaatagcacggtcgcttcgttgtccacgtcgacctcgaccggcatcggctcgctttccactggcctgagcagcacgaacagttcgttgacctcgctttcaacgtccgcctcgtcgggcatcagctcggccaatagctcggttgcttcgctgtccacgtcgacctcgaccggcatcggctcgctttccaccggcctgagcaccaccaacagctcgctgacctcgctttcaacgtccgcctcgtcgggcatcagctcggccaatagctcggttgcttcgctgtccacgtcgacctcgaccggcatcggctcgctttccaccggcctgagcaccaccaacagcaacctcacgtcgctgtcgacctccacgtcgacggggctctcgtcggccaacagctcgatcacctccctttcgagcgggctgagcacgaccaacagcaacgtcgcctcgctgtcaaccggcctgagcagcacgaacagctcgttgacctcgctttcaacgtccacctcgtcgggcatcagctcagccaatagctcggttgcttcgttgtccacgtcgacctcgaccggcatcggctcgctttccaccggcctgagcaccaccaacagcaacctcacgtcgctgtcgacctccacctcgaccggcctctcgtccgcgaccagctcgatcgcttcgctgtccacgtcgacctcgaccggtatcggctcgctttccaccggcttgagcaccaccaacagcaacctcacgtcgctgtcgacctccacgtcgacggggctctcgtcggccaacagctcgatcacctccctttcgagcgggctgagcacgaccaacagcaacgtcgcctcgctgtcctccggcctgagcagcacgaacagctcgttgacctcgctttcaacgtccacctcgtcgggcatcagctcagccaatagctcggttgcttcgttgtccacgtcgacctcgaccggcatcggctcgctttccaccggcctgagcaccaccaacagcaacctcacgtcgctgtcgacctccacgtcgacggggctctcgtcggccaacagctcgatcacctccctttcgagcggactgagcacgaccaacagcaatgtcgcctcgctgtccaccggcctgagcagcacgaacagctcgttgacctcgctttcaacgtccacctcgtcgggcatcagctcagccaatagctcgattgcttcgttgtccacgtcgacctcgaccggcatcagttcgttgtccaccggcttgagtaccaccgacagcaatctcacgtcgctgtcgacctccacgtcgacggggctctcgtcggccaacagctcgatcacttccctttcgagcgggctgagcacgaccaacagcaacgtcgcctcgctgtccagcggcttgagcgccaccaacagctcgctgacctcgctttcaacgtccgcctcgtcgggcatcagctcagccaatagctcggttgcttcgctgtccacgtcgacctcgaccggtatcggctcgctttccaccggcttgagcaccaccaacagcaacctcacgtcgctgtcgacctccacctcgaccagcctctcgtcggccaacagctcgatcacttccctttcgagcggactgagcacgaccaacagcaacgtcgcctcgctgtccagcggcttgagcaccaccaacagctcgctgacctcgctttcaacgtccgcctcgtcgggcatcagttcagccaatagctcgattgcttcgttgtccacgtcaacctcgaccggcatcagctcgctgtccaccggtttgagcaccaccgacagcaacctcgcctcgctgtcgacttccacgtcgaccggcctctcgtccgcggccagctcgatcgcttcgttgtccacgtcgacctcgacgggcatcagctcgctgtccaccggtttgagcaccaccgacagcaacctcacgtcgctgtcgacctccacgtcgacggggctctcgtcggccaacagttcgattacctccctttcgagcggactgagcacgaccaacagcaatgtcgcctcgctgtccagcggcttgagcaccaccaacagcagcgtcgcgtcgctctcgaccggcctgagcaccaccgacagcaacctcgcctcgctgtcgacctccacgtcgaccggcctctcgtcaacaaccagctcgatcgcttcgctgtccacatcgacctcgacgagcgtcgactcgctgtccaccggcctgagcaccaccaacagcagcgtcgcatcgctctcgaccggcctgagcaccaccgacagcagcctcgcctcgctgtcgacctccacgtcgaccggcctctcgtcaacaaccagctcgatcgcttcgctctcgacgtcgacctcgacgagcttctcgtcggcgctgagctcgatcggctcgctgtccaccggcctcgcgacgaccaacagcaatctcgcgtcgctgtccacgtcgacgctcacctccgtgagctcgctgtccaccggcctgagcgccaccaacagcagcgtcgcgtcgctgtcgacgtccgcctcgaccggcctcgccgcaaccaacagcacggtcgcctcgctgtccacatccacctcgacggccgtcggctcgctgtccaccggcctgtcgaccaccaacagcaacgtcgcctcgctgtccacgtccacctcgacggccgtcggctcgctgtccaccagcctgtcgaccaccaacagcaacgtcgcgtcgctgtccacgtcgacttcgacaagcgtgaactcgctgtccaccggcctgtcgacgacgaacacgagcgtcgcgtcgctgtcgacgagcgtgaccaacctcaacacgcagctcacgtcgctgtcgacgacgatcgtcaacagcacgaacaacgtgatccgcgcgctgcccgcgagcacgggcatcgccgccgacatgagcgcgccgaacgccgccgcgccgtccgtcacggccggctcgaactcggtcgcgctcggcgcgaactcgaccgacggcggccgctcgaacgtcgtctcggtcggcagcgccacgcagcagcggcaaatcacgaacgtcgccgccggcaccgaaggcaccgacgcggtcaacgtcaaccagttgaatgcgctgtccacttctatgtcacaatctctggcgggccagcagggccagatcaacaatctgggctcgcagctgacccagactcagcaagcgctgcagcagaccgatacgatggcccgtcagggcatcgcggccgccaccgcgctgacgatgctgccgcaggtcgagccgggcaagacgatcaatgtcgccgtcggcgtcgcccgcttcgcaggtcagtcggggatggcgttcggcgcgagcgcgcacgtgacaaccaacggcattctcaaactgggcatcggcgtgtcggggcagaacaagaccttcggtgcaggatatggatatagctggtga

SEQ ID NO: 1115 - DNA, 1551 bp, Burkholderia pseudomallei
atgcacgccaaagcttcctccagccacgcgcccgacgcgcccaagcccagctccattgccaccacgctctgccgggcgcttgcatccctttccctcggcttgtcgatggacgccgaggccaatccccccgaaccgccgggcggcaccaacattcccgtgccgccaccgatgccgggcggcggcgcaaacattcccgtgccaccgccgatgccgggcggcggcgcgaacatcccgcccccgccgccgcctcccggcggcattggcggcgcaacgccctcgcccccgccgctcacaccggtcaacggcaacccgggcgcgagcacgccgaccaagaccggtctgctgaaaacgctcaatcggttgtccgcggagcttcagaacaacccgcgtgtaaccgaggacgtagtcgacaacgtggacgcggtcatccgaaacgccgtcaatctggcgcccgatgcgaacggggacttctccggccgctcggcgatgccgatcgaaatggccgcgaacgccgcgctgagatcgctgaagaaaaatccgggcgacgccggccatgccgctccggcatacctgcctgccgagcggatcggccagttgcgggaaaaggtccgaaggaccatcgaggcgctcgaatcgaaccgcccaccgaaaccgcagccgcggtcgacaccaccgcaatcgacgccacccaagccgacgcagcacccgaccgcgcccaacccgaacgtacccgacgcatcgacgcctgatgcatcgacgcctgacgcttcgacgcccgacgcatcgacgcccgacgcatcgacgcccagccgacctgcccctgccccccgagcgggcacgggcgcgcccgctgcttcggcggcgacgcgcgcccccgcctttgcaaaccgcgtgcgcaagccgaatccggctatgcccgccgcgtcgtcgcatgcgatcgcgagcgacttcgcgtcgagcaacgcgttcgcgatcggcgacgactcgaccgccgtcggagcgcaagcgatcgcgttcagcgagcaatcgatcgccataggctcgcgcgcgattgccgccggcgcccgttcgatcgccgtcggcacggacgcgacagcagccgcccccgattcggtcgccctcggctcgggctccatcgccgaacgcgaaggcacggtgtccgtcggcagagacggccacgaacgccagatcacccatgtcgcatccggcaccgagcccaccgacgccgtcaacgtcacgcaactgcgcgcggcaatgtcgaacgccaacgcgtacacgaaccagcgcatcggcgatcttcagcagagcatcaccgacaccgcgcgcgacgcgtattccggcgtcgccgccgcgaccgcgctgacgatgattcccgatgtcgaccgcgacaagagggtgtcgatcggcgtcggcggcgcggtctacaagggccatcgcgccgtcgcgctcggcggcaccgcgcgcatcaacgaaaacctcaaggtgcgggcgggcgtcgcgatgagcgcgggcggcaatgccgtgggcatcggcatgagctggcaatggtaa

SEQ ID NO: 1116 - DNA, 786 bp, Burkholderia pseudomallei
atgacttacaacccgagaatcggcggattcacgcacgtcaagcaggcgtcgttcgacgttcacgtcaagcgcggcgaagcgcagccgcgcacgtcgttcgcacaacagatcaagcgcatcttcagcaagatcggcgaaacgctcgggcaactgttccgccaccgcgcgccggacagcgcgcccggccgggtcaggctgcagggcgtgcgctacgtcggcagctatcggcccacgggcgacgcgaaacaggcgatccggcatttcgtcgacgaagcggtcaagcaggtcgcccacgcgcgtaccccggagatccggcaggatgccgaattcggccggcaagtctacgaagcgacgctctgcgcgatcttcagcgaagcgaaggaccggttctgcatggacccggccacgcgcgcgggcaacgtgcggccggcgttcatcgaggcgctcggcgacgcggcgcgtgcgacggggctgcccggcgccgacaagcaaggcgtgttcacgccgagcggcgccggcacgaatccgctctacaccgagatccggctgcgcgccgatacgctgatgggcgccgagctggccgcgcgcccggagtatcgcgagcttcagccgtatgcgcggcagcaggcgatcgatctcgtcgcgaacgcgttgccggccgagcgttcgaacacgctcgtcgagttccggcagacggtgcagacgctcgaagccacataccgccgcgcggcacaagacgcgtcgcgcgacgagaagggcgcgacgaacgcggcggacggcgcgtga

SEQ ID NO: 1117 - DNA, 291 bp, Burkholderia pseudomallei
atggcgacatacaaggaactgaaggctcgggccgaggcgctgagcgcgcaggccgaagcggcgcggcaggctgaattgcaggccgcgatcgaagacgtgcgcgcgaaggtgcgcgagtacggtctcacggcgtacgacgtgttcggacaccgaaagaagccgggcgagcgccatcgcggggcggtcaggccgaagtaccgcgatccggcgacgggcgcgacctggaccggacgcggcatcgagccgaaatggatccggggccgcaatcgggacgaattcctgatcgaatga

SEQ ID NO: 1118 - DNA, 1236 bp, Burkholderia pseudomallei
atggccgagaaaaccgagaagccgaccgcgaagaagctgcgcgacgcggcgaagaaggggcagacgttcaaggcgcgggacatcgtcgcgctcatcgtgatcgccacgggcgcgctggccgcgcccgcgctcgtcgatctgacgcgcatcgcggccgaattcgtgcggatcgcgtcgacgggcgcgcagccgaacccgggtgcgtacgcattcgcgtgggcgaagctgttcctgcgcatcgccgcgccgttcgtgctgctctgcgcggcggcgggcgcgctgccgtcgcttgtgcaaagccgcttcacgctcgcggtcgaatcgatccgcttcgatctcaccgcgctcgacccggtcaagggaatgaagcggctcttcagctggcgctcggcgaaggacgcggtgaaggcgctgctctatgtcggcgtgttcgcgctcacggtgcgcgtgttcgccgatctctaccacgccgacgtgttcgggctgttccgcgcgcgtccggcgctgctcggccacatgtggatcgtgctcacggtgcgcctcgtgctgctgttcctgctgtgcgcactgcccgtgctgatcctcgacgccgccgtcgaatacttcctgtaccaccgcgaactgaagatggacaagcacgaggtgaagcaggaatacaaggagagcgagggcaatcacgagatcaagagcaagcggcgcgagattcatcaggaactgctgtcggaggagatcaaggcgaacgtcgagcagtccgatttcatcgtcgcgaacccgacccacatcgcgatcggcgtctacgtgaatccggacatcgtgccgattccgttcgtgtcggtgcgcgagaccaacgcacgcgcgctcgccgtcattcggcatgccgaagcgtgcggcgtgcccgtcgtgcgcaacgtcgcgctcgcgcgctcgatctatcgcaactcgccgcgccgctacagcttcgtgagccacgacgacatcgacggcgtgatgcgcgtgctgatctggctcggcgaggtcgaggcggccaatcgcggcgggccgccgcccgagacgcgcgcgccgacttcggccgagccgcaagcgcgcgacggcgtggccccgccgggcgacgcctgcgcggacaacgcctttcccgacgacgccccaccgggcgccgctgcgccgaacgccggttcgccggacggcccggcgccggacggcggcgcgccggcccgaacgggcgatcaaaacgcttga

SEQ ID NO: 1119 - DNA, 756 bp, Burkholderia pseudomallei
atggatgtcttgatgcaagcgttctaccggcacgccggcgcgatcgcgatcgcgtacgcgcgcgtcgcgccggtgttctatctgctgccgttcctgaacgaccggacgatcgtcaacggcatcgtgaagaacacgatcgtgttcgcgatcatcctcgggctgtggccgagcttcgcgcatccgccgctgcaaggcggcgcgctcgccggcgtcgcgctgacggaggcggctgcgggcgtcgtgctcggcgtcgcgctgtcgctgccgttctgggtcgcgacggcgttgggcgagctgatcgacaaccagcgcggcgcgacgatcagcgattcgatcgacccggcgacgggcgtcgaagcgtcggcgctcgcgccgttcgtgagcctgttctatgcggccgcgttcctgcagcagggcggcatgctgacgatcgtcggcgcgctcgaggcgagctacgcgacggtgcccgccggcgcgctgttctcggtcgatctgccgcgcatcggcgcgctgttgaccgatctcgtcgcgcacgggctcgcgctcgccgcgcccgtgctgatcgtgatgttcgtcaccgatgcgctgctcgggctgttctcgcgcttctgcccgcaggtcaacgcgttctcgctgtcgctgacggtcaagagcatcgtcgcgttcgccgtgttccacctgtacttcgtatacgcggcgccgcacgagctgacggcgctgctgcgcgtgcatcctttcagcagcctggtgaagtga

SEQ ID NO: 1120 - DNA, 1863 bp, Burkholderia pseudomallei
atgatgtatgccgacacggccagacgatacgcagccgcgcttgccgcgtcgctgctgatgacgggcgcggcgttcgccgcgccgaccgacgcggcgccgctcgccgacgcgcccgcggcggcgagcgcgacgcccgacgcgcgggacggcgacgcgtcgcgcgtggccgcgccgcaggacgacgagcgccacttcgtcgcgaacgacgcgagcatcagcgtgctgctcaatgcgctgtcgggccggctgcacaagccgatcgtcgcgagcgagaaggtgcgccgcaagcacgtgacgggcgagttcgacctcgcgcagccccgcgcgctgctcgcgcggctcggcgaatcgatgtcgctgctctggtacgacgacggcgcgtcgatctacatctacgacaactcggagatcaagaacgcggtcgtctcgatgcgccatgcgacggtgcgcaacctgcgcgatttcatccggcagacgcggctctacgatccgcgctttccggtgcgcggcgacgacctgagcaacacgttctacgtgacgggcgcgcccgtctacgtgaatctcgtcgccgccgccgcgcgctatctcgacgaggtgcgctcgaacgaggcgagcgaccggcaggtcgtgcgcgtcgtgcagcttcacaacagcttcgtcgtcgaccgccagtacacgctgcgcgacaaggaagtcgacatcccgggcatggcgaccgtgctcggccgcatcttcggcccggcgcggccgggcgcgccggcggactcgcccgtcgcggcggccgacgccacggcgcgcggcggcgcgggcggcgcggcgggcaagccggcgttctcgcttgccgatgcgttgcccgcgccgctcgacgccggcaacgcgccgggcggcgcgggctcgacgcattcgacaaacccggcgaacgccgcgagcccgatgggcggcgcggcgggcggcgtcgcgctgcccgcgtcggacggcgtgcgcgcggtggcgtatccggacacgaacagcgtgatcctcgtcggccggctcgacaaggtgcaggacatggaggcgctgatccgctcgctcgatgtcgagaagcggcagatcgagctgtcgctgtggatcatcgacatccgcaagagccggctcgatcagctcggcatcgactggcagggtgcgctcaatgcgccgggcatcggcgtcggcttcaacaatcgcggcggcaacgtgacgacgctcgacggcaccaggttcctcgcatcggtcgcggcgctcagccagacgggcgacgccaccgtgatctcgcggccgatcgtgctcacgcaggagaacgtgccggcgacgttcgacagcaaccagacgttctacgcaaagctgatcggcgagcgcacggtgcagctcgatcacgtgacctacggcacgctcgtcaacgtgctgccgcggctcacgcgcgatgggtcgcaggtcgagatgatcgtcgacatcgaggacggcaacaccgacggcgcgacgagcgacggccagatcgtcatcgacaacaacacgatgccgctcgtgaaccgcaccgagatcaacacggtcgcgcgcgtgccgcacgagatgagcctgctcatcggcggcaacacgcgcgacgacgtcacgcgccgcacgttccggattcccgggctggccagcattccgctgatcggcgggctgtttcgcgggcattcggatcggcacgagcaggtggtgcgcgtgttcctgatccagccgaagctgctgcgcgcgggcgcggcctggcccgacggccagccgtgggaatcgggcgatccggcggacaacgcgacgctgcgcgcgaccgtgcagatgctcaaaccctacatggacgacaagtcatga

SEQ ID NO: 1121 - DNA, 642 bp, Burkholderia pseudomallei
gtgtcgttcggcgcgatgtcccatgccgtttcgatcgacaagaataaatcggcgctggttatcggcatcggtcaattcaaaatcgcgtcgcgtgaaggcgcatggcgttttcatgacgtgccgttattcgaggcggcgaaattgctcgcttttctggaaagctgcggcgcgccggacggcgccggccgcgaatatcgcgcgggggcgccggacggcgcggtgatcgacgcgcccggcgatctgagcatctggaaattcgaccgctggctgatcgcccgcgtgatgggcgcgccgcacggcgccgatccgctgttcgcgttcctgcgcgcgcaggagagctacgggctcgtgcgcttcttgctgcgcgagcgtgcgaacccgcagccgatcgccgcgcttgccgcgcgctacggcgtgtcggagccgcactttcgccggctgtgccggcaggcgctcggccgcggcctgaagcgcgagcttcggcaatggcgcgccgcgcaggcggtgctcgaggtggtcgagagccgcgacagcatgaccgaggtcgcgatgagcaacggcttcgcgtcttcgtcccacttctcgcgggaaatcaaggacttgttcggcatttcgccgtgccggttccgtcgccggacatga

SEQ ID NO: 1122 - DNA, 1287 bp, Burkholderia pseudomallei
atgaataaaccagattccggacttgaagctctgcaactccgaatcctgttcggtccgctattcggctcggatatcgcgattctgtcaggggaagtatttttctgcgtcggcgagcaggtgatcgacgatcgtccggcggagcatccggaaaatcgcgccggccatttactggagcgcgcggtcgatacgctgtatatcccgcaccgggccggcgcgccgaatttccgcctgcgttttccgggcgcgccgacgcaggcggcgcgaaccgccgaaaccggcgaagccgcgcccggcgatttcgaagtcgattttctgtcggcggacggttgcgtcacgcaacgcgcggcattcaacaccgtctgccgcttcggcgatctcgcgttcgcgctcaggcgtcagcgcgagccatggagcgaggcggtcatgcactacgcgccgcacgcgccttcgcgtgcggcggacgccgccgagccgggcgcgcccggtgagcccggcgatggcggcgagcgcgcatcgcgcttcgcgctgaagctcggcgcgctgctcgtcgcgggggtcgcgctcgcggcgctcgcgtactggcaggtgcagcgctatgtcggcgcgcagaagctcgcgagcgtcaacggcgtgctggcgggcgcgcccgtgcccaacgcgatcctgcccggcgacgacggccggatctacgtgctgagcgcatcgcaggacggcgccgaatgggaccgcgaggcgctgctgaaggcggcgctgccggagaagatcgaagtcgccgtgatcggcgcggagcggcaacgcgtcgagcgccggctcgacgaagccggcgtcgatttcgtgaccgtgcgcctcgacgcgcccgagcacccggagctgatcctcaccggcgccgcgcccgccgccgcgcgcgcacgcgcgatcggcgagctgcggcgcgcggccccgtacgtccgggacgtgcgcgtgatcgacgcgagcctcggcgcgatcgagcaggaggcgcgcaacgcgctcgacaaggtgggcgcgcgctaccggctgctcgcgcggcgcggcggcgcgacgttcgaggtggcgagctcgttcggcgacgaggagctcgccgccttgcagaacctcatgcgctcgttcggccacaagtggggcacgcgccgcgtcgatttcaagatcgcgctgcgcaccgactggctgaagggcaaatcgtatcgggaaggcggcgacggctacgtgctgctcgatcacgcgtcctggtatttcccgcaacccctggaaggagcacattaccgatga

SEQ ID NO: 1123 - DNA, 885 bp, Burkholderia pseudomallei
atgcgaaagccggcgcatgcccgcttcaatcacgatagctccgcacggtcggcatcccgcccgaacccgccggcgcgcgttttcggcgatgatccggtgcgtgcgcgagcgcggcggcccgcccgcatcgccgtgcaccgccgtcgacctcgaaccgtccatcgtcaacgcgccgtcaaccgccgccgcgcggcgcgcttcgcgcatgcgcccggcgcgcacggcccacgcccgaacatgatcgccgatcccgtcctgcatacgctgctgctccgaaccggccactggctccgtcgtcacacgcgcggcttctcgcgctcggatttctggcccggccgcgcgttcctcgaagcgttcacggtcctcgccgcctgggtgctgcccgcgatcgcgggcgtcgtcgcgaccggctggctcggcggccaccgctcggtcacgtatcttcaggcagcgatccaggaaggcatcggcccgcacatctggaacgtgttcggaacgctcggcgcggttctcttcggtctgctcgtcgccgcgccaacgcagagatggctcgcgctcgccgcgcatcaggtgatgctcaacgcctattcgctcggcgcgctgatgctgggcctgctgctcggacaatggatctgcatcggcgcgccgccggcgtccggcctccttcatgcgtcgctgcgcacggccgggatcggcgcgctgttctcgatcgccttcgggctgaacctcgctgtctggtacgtcgcgtttctcgcgtcgcccaagcgcctgcataccggcttcatgctgaagatcgcgcagtgcgcgccgcagtttcgcgtgccgctcgccgcgacgatcgtgacggcggcgctcgcgtcgctctatctctatctcggccgatga

SEQ ID NO: 1124 - DNA, 1674 bp, Burkholderia pseudomallei
gtgctttcgcgccgccgcgcgcgcggcttcgcgctgatcgagatgctcggcgcgctcgccatcgccgcgctgctgctcgccggcatcgcggcgatgatggacagctcgctcgacgacgtgcgcgcgcagcaggccgcgcaataccaggcgcaggtgacggccgcggccacgcgtgcgctcaagcgtgactacgacgcatggctgcagcgcgcgaacgcgcagacgcccgtcgtgatgacgcttgccgatttgcaggcgacgaacgatctgcccgccgcgctacagacacgcaacgcgtacggccagcacacgtgcgtgctcgtcaagcgcaccgcgaacggcgtcggactcgacgcgctcgtcgtgacgacgggcggcgaggcgatcggcgacaaggagctcgggctcgtcgccgcgagcgcggggccgggcggcggctcgatcgccacgagcgcgcccgcgctcgcgcgcggcgcgttcgacgcgtggcgcatgccgctcggcgcctacctcggcggcagctcgccgacgtgcgatccggccgacgccgcgccgccgaacgccggccatctcgccaacgagatcttcttcaacgggccgggccagcagatcaacagcgattacctgtaccgcgtcggcgtcggcggccatccggaggcgaacgcgatgcaggtgccgatctggctcacgcacacgttcgtcgaaggcgccgccgacgcggcgaactgcggcgcggccggcagctatgcgaacggcaagctcggcgcggacgcggccggacagttgctgagctgcaggaacggcgtgtggcgcggcgccggcggtcactggaaggacccggtcaggacggccgacgatctgcccaccgacgcatcgaacgaaaccggcgacgtgcgcctcacgctcgacacgttccgcgcgttcgcgtggacgggcaacgcgtggcaggcgctcgccgtggaccagaacggcaacatgatcgtgccgggcgtcgtctccgcgaaccagtacgagatcaccgggcgcgtcgtcgtcaacacgccgtgcgcgccggagccgagccggccgaacgcggggctcgtgtctatgggccaggacgggcaggtgctgtcctgccagggcggcaagtggctgccgcaatcggggatcaagatcggcggcaccgaaacggcgtgcgagatcctgatggagacgcccggcgcgacggatttctcgtgcgggtacacctaccgcggcccctatccgaatccgccgctcatcacctacgagcccgacggcacgtacacgtacacgatcaaccggccggtgaagctcgacaacaacgggctcatcgcggtgagcgcgtacatgcacatgagctacgcgacgtgcgcgctgaaagggcgggaaggacagatgcgtctcgtcgtcgacgtgatcgacgttcagagcaaccaggtgatcgcgcacggcgaggcgcagtcgacgaagctgatcgaggacgccgcgacgatcaacgtcacgctgaatcaggccgccgagccgcgcagcggctacacggtcaggctgtcgagcaagtgggcgacgtacgacagctacgcgggcacgccgtggacgtcgagctattgcagcggcggcaagacgtttctccagacgccgctcgtgaccggctggacgatcaattcgttctattga

SEQ ID NO: 1125 - DNA, 1299 bp, Burkholderia pseudomallei
atgagcgcgcaggtgattcaaatcggccgccagcgtttcgtcggcggcctgttctggcaatcgttgtcgaggcgcaacgagttgcgcgccgaagcggtcgagctcgcgaagaaactgaagttcgacctgatggtgctgcgcatcgatcgcggcgtcgcggcggcgggctacgcgaacacgcgcgacggcttcgcgcccgggcatctgtcgctcggcgcgatggtgtcgcgcgcgatcgcgctggagggcgcgttctacaacggccggcgtcagcccgcgccgaactggctcggcgcgtttgcgctgcccgacgggcgctgggcgtacttcgcggtgcgcgaccacgcgttcatgccgaacggcgactgggtcggcagccgcgaggaggcgctcgagcggctgcataccgattacgcgtggggcggctggaacgtcgtgatcggcgagccggagctcgagcggcagggcttccagaattttcagccgaagcggctcgacgatctgctgccgcgccgcggcggccggccgcgcaccgagcgctggtgggcgcttaggcccgtcgagcggcgtctgtcgccgcgcgccgcgctgatcgccgcgacggcggcgtgcgtcgtgctcggcggcgcgttcgcgtactggcatcatcgcgcgaaggtcgaggccgaggagcgcgaggcggcgctcgagcgcgtgcgcgcggagctcgccgcgcggcaggcgagaagcggccccgtcgcgccgccgtgggcggcgctgcccgacgcgctcgcgttcgcgcgcgcgtgcgcgatgcgcttcgggcggctcgcgccgggcggctggcggctcgaacgctacgagtgcacgccgggcaccgcgcactacgcgtgggcgcgcaacggctcgaacgtgcgctacctgctcgtggtggaacccggcgcgacgctcgataccgacggcgagcgcgcgacgctcgacgtgccgctcaccgcgccgacggcgaacgatacgccgctcgccgacgattcggttgtcaggacacaacttctcgcgcgtctccaatggctcgacgcggccgctaaactggagcggctgcttcccgaacaggggccgcgcgcgccgctcgcgaatctcgcgcaacaggcggccgccttgcccgcttcgcccacgtggcgcgcgtaccggctgaacgcgaatctcggcggcatcgcgccgccggagttcgtgcgcgcgatcgacgtgccggggttgcgcgtcgagcgcatcgcttaccagaacaatcagtggaccctcgaaggagtgctctatgcgaaatag

SEQ ID NO: 1126 - DNA, 1770 bp, Burkholderia pseudomallei
atgcgcgtgctgttcgccatttcattgctggccgtcgcatggctcgccggctgcaccggccttcgcggcggcatcgagcgcgacgcgcggcgcgattcgaacgaaaccggcgcgctgctcaagcgcgcatccgacggcgacaacagcgtgcgctcgctcgcgcccgtcgtcgtcgacaacgggctgtgggtgtccgcgggcaccgtcaagctgcgcaacagcgagcagttgccgccgctgttcgacgagccggcgtcgttcgatcgctcggtcgcttcgttgtccgaattcgccgagcagatcacgcgcctgacccaggtgccgacgcaggtcgccgcgagcgcgcagcaggcggccgcgcgttcgcagcacggcggcgcgggcgacgccgcgcgcggcgcgccggcctttctcgacgcatcgggcgcgcgcgcggtgccgccgctgccccccggcctgccgggcggcgcatcggcgggcggcggcaagacgggcggcggcgcggcgggcgcgggctcggagggcggcggcacgtcgttcgcgccggtgcgcgtgctgtacgcgggcggcacgctgcgcggcctgctcgacgcggcctgcgcgcgcttcggcgtgtcctggaagtacgagcagggggcgatccgcttcttcttcaccgatacccgcacgttccaggtcaacgcgattccgggcgactcgtcgctgaacgcatcggtcgtgagcggcgcgacgagcgacggcgccgcgggcggctcgcagtcgggcggctcggggggctcgggcggcggcatcaacggcgcgggctccggcacgacgggcctcaccgcgaacaacacggcgaacaccgcggtgaactcgcagctgtcggtgttcaacggcctgcaaagcgcgatccaatcgatgctctcgcgctacggcagctcggtcgcctcgcccgcgacgggatcgatctcggtgaccgacacgcccgacgtgctcgagcgcgtcgccgcgttcatggcgcagcagaaccgctcgctgtcgcggcaggtgctgctcaacgtgaccgtgctcagcgtatcgctgcaggcgggcgacgcgtacgggatcgactggaacctcgtctacaagacgatgtccgcggggttcggcatcaccaatccgttccatccgacggcgctgacggcgcccgccgacatgtccgcggcggtgctcagcccgacgagccgcttcaacggcacgaagctgctgatccgcgcgctgtcgcagcaggggacggtgcggcgcaagacgtcggcgtcggtcacgacgctcaacaaccagccggtgcccgtgcaggtcgcgacgcagacgggctacctcgcgtcggtgtcgacgacgaacaccgcgaacgtcggctcgtcgacggcgctcacgccgggcgtcgtgacgacgggcttcaacatgacgctgctgccgcacgtgctcgacgacggcaccgtgatgctgcagttctcgaccaacatctcgtcgctgctcgagctgaaggaggtgacgagcagcaccggcggcagcggcctggcgcgcatccagacgcccgacgtcgacatgcgcaacttcctgcagcgcgtcgcgatgaaatcgggcgagacgcttgtcatcagcggctacgaaggcgcgaacgattcgctcgacgagcgcggcgtgggcacgccgaagatgatcgcgctcggcggcggctacgaggcgcagcgcgcgcgcgaggtgatcgtgatcctgatcacgcccgtcacgcagcgcggcggcgcctga

SEQ ID NO: 1127 - DNA, 1446 bp, Burkholderia pseudomallei
atgttttcgacactctatttcgccgccgccgccgcgctcgccaatccgtcgtcgaacgacgcctacgccgcgcgcgtgctcgacggccgcttcgccgaagcggtcgcgctcgtcgccgcgcgttgcgactcgcagccgggcgatgcggctgccgacgtgcgcgacgttcatgcgtacgcggacatccagctcgtgctcgggcgcttcgaggaagccgaggacacgttccgccgcgcgcagaagctgctgcgcgaatcgcgcgaccagacgcgcgtgatgacctgccgcaacgcgagctggcaggcgttcttccagaaccgcttcggcgtggcgcaggccgggttccggcggatcgccgacgatcgcgcggcgagcgccgcgcagaagctcgagagcctcgtcggcacgtgtgtcgtcatgcatcatctcggccgcgccgaggacgcgatggcgacgctcgacgtgctcgacgcggccgcgcgcggcgacgccgatgggcgctgggtgcggctcgcggccgcgctgcgcgcggatctgctgctgcaataccagatcggccgcgccgacgcgctcggcgatcacgtgtactggcgctcggcgctcgccgagctgccgccggcggcgttcgcggaaacgggcgcgccgcacgccgcttgcgcggccgatgcgccgccgctgctgcgcatgcgcgtcgcctacatgcgcgagacgcgcgcgctcgccgcgggcgaccacgcggcgctggggcgaatcgacacgcacgtgagctggtgcgcgaaggcgggcctggccgactatcagcgcagcgtgcgcctggaggtcgcgctggccgcgcttgcgggccaggcgccgaacgtcgccgacgcgatgatcgcgccgtaccgcgaggccgcggggcgttgcggctcgcacgcgcgctggacgctcgactacctgtactgcgcggcgaaggtgcgcgagcaacaggggcggattcgcgaatcgtcgtcgctgtacgcgcactatgcgctcgcgtcggtgcggcacgtgcgctccgacggcgcggcgctcgcgccggcgctcgcgatcgcgcgctgcggcacgcaggcggccgcgccgagcgacgacgtgagcgcgaggctgcccggcaagtaccggcgcgcgtatcgctatctgatggagcggctcgaccagcgcgagctgtcggtgcgcgagatcgccgcgcacatcgacgtgaccgagcgcgcgctgcaggcggcgttcaaggcctatctcgggctgtcgccgagcgagctgatccgccgtcagcggatggagcggattcgcggcgagctgctgtccgacgcgccgcgcgcggcgagcgtgctcgagatcgcgagccgctggggaatccagcatcggtcgacgctcgtgaacggctatcggcgcatgttcgacgaggcgccttcgcagacgttcgaccgatga

SEQ ID NO: 1128 - DNA, 651 bp, Burkholderia pseudomallei
atggttcagtttaacgacatcaccggcctcttgatcgccgtgctcgtgatgagcatggtgccgttcatcgcgatggtggtcacctcgtacgcgaagatcgtcgtcgtgctcggcctgctgcgcaacgcgctcggcgtgcagcaggtgccgccgaacatggtgctcaacggcatcgcgattctcgtgtcgctgtacatcatggcgccgatcggcttcgccgcgcagcagcagcttcaggggcaggcgctgtcgccgcagccgacgcaggcgatgctgcaggcgttcggcgcggcgaaggagccgtttcgccggttcctcgccgcgcactcgcgcgagcgcgagaagcgtttcttcctgcgctccgcgtcggtgatctggccgcaggccgcggccgcgcaactgcgcgaggacgacctgatcgtcctcgcgcccgcgttcacgctcgcgcagatgaccgatgcgttccgcatcggcttcatcctctacatcgcgttcatcatcgtcgatctcgtgatcgcgaacgtgctgatgtcgatggggatgaaccaggtgcagccgaccaacgtcgcgatcccgttcaagctgatgctgttcgtcgtgatggacggctggtcgacgctcgtgcacggcctcgtgctgacctattcctga

SEQ ID NO: 1129 - DNA, 2073 bp, Burkholderia pseudomallei
atgacgctgaaatccctcaaacttcccgccggcggcgaggtcggcatcacggtgctcgtcgtcgcgatcgtctcgctgatgatcctgccgctgccgcccgaggtgatcgacgtgctgctcggcgtgaacatcgcgatcagcgtcacgctgctgatggtgacgatgtacgtcggcagcatcgtgtcgctgtcggtgttcccgtcgatcctgctgttcacgacgctgtaccggctgtcgctgaacatcgcgtcgacgaaatcgatcctgctgcacgcgaacgcgggcgacatcatcgagagcttcggcgagctcgtcgtcggcggcaatctcgtcgtcggcctcgtcgtgttcctgatcatcacgatcgtgcagttcatcgtgatcgcgaagggctcggagcgcgtggccgaagtcggcgcgcgcttcacgctcgacgcgatgccgggcaagcagatgagcatcgacgcggatctgcgcgcgaacatcctgacgccggacgaggcgcgccgcaagcgcgcgacgctcgccaaggaaagccagttgcacggcgggatggacggcgcgatgaagttcgtcaagggcgacgcgatcgccgggctcatcatcacgctcgtgaacatcgtcgcgggcatcgcgatcggcgtgatgtaccacgggatgacggcgggggacgccgcgaaccgcttctcgatcctgtcggtcggcgatgcgatggtgtcgcagattccgtcgctgctgatctcggtcgcggccggcgtgatgatcacgcgcgtcgccgacgatcacgacgacggcgacggcacgtcgctcggctcggagatcgccaggcaactgggcggcagccatcgcgcgctgtatttcgccgcggtgctgctgatcggcttcgcggcggtgcccggctttccggccgcgctcttcgtgctgctgtcgggcatgctcgcgttcgccggctaccggctgcaaaagggcgcgcggcgcacgaccgcgcgcggcgagccggtgatcgcgctgcagcgcgcgggcgcgaagagcagcacgccgtcgatcctgccgcgcgcgccgctattcacctgcgcgatcggcgtgcgcgtcgcgcccgatctcgtcgcccggctcgcgcccgccgcgctcgaccgcgcgttcgacgaggagcgcgcgaagctgcaggaggaacaggggctgccgtttcccggcatcacgctgtggacgagcgacgcgctgcccgcgtcgacgtgcgagatcctgatgcgcgacgtgccgcaggcgcggctcgagttgccggccgaccagacgatgctgcccgacgcggcgtcggacccggcgctcgccggccgctgcacgaagcgcgggcccgcgggcggcctcgccgagagctactggatcgacgacaaggcggtgccggccggcgcgcgcgcgtggcgcgccgagcaggtggtcgcgcacgagacgatcgcgctgctcaggcgcaacgcgcacctgttcctgggtattcaggaagcccaatggatactcgaccagctcggcgtcgattatccggggctcgtcgccgaagtgcagaaggcgctgccgacgcagcgcatcgccgacgtgctgcgccgcctgctcgaggagcacattccgatccgcaacgcgcgcgacatcatggagagcctcgtcgcatgggggccgaaggagaaggacatgctgatgctcgccgagtacgtgcgcggcgacctgtcgcgctatctcgcctatcgtgcggcgcgcggcgcgcggcagttgccggccgtgctgctcgacatggcggtcgagcagcacatccggcagtcgatcaagcagacgcccgcgggcaactttctcgcgctgccgcccgagcaggtgcgctatctcgtcgacagcgtcgcgtcgttcgtcggcgaagcgccgcgcgacgatgtcgcgctcgtcacgtcgatggacgtgcgccgctacacgcggcgcatgatcgaggcgcggctcgactggctgcccgtctattcgtatcaggagctcggcgaccaggtgcaattgcagccggtcggccgcgtgacgatgccgacggcggcccacgcatga

SEQ ID NO: 1130 - DNA, 2421 bp, Burkholderia pseudomallei
atgcatttctttcgattcgcgtggcggcacggccgatattggctttgcctgctgattgcgagcgtattgctgccgcaaggcgcggcggcggccgtcacggcgtcctacacggacatcgtcggcgcggacagcgggctgtgcgtctcgacggccggcaactcgagcgcatcgggcgcgggcgtcgtgcagacctcgtgcgcgggcctgagcaacacgacatggtcgttcgttcccgtcggcaaccgctatcacatcgtgctgcaaggcagcggcctgtgcctgaacgtgcccgggggctcgctgaacagcggcacgcaattgatccagtacgcatgtcagggcaacggccagaccaatgaccaatggacggtcgtcgcggtcggctcgagctaccggatcgtgtccgcgtcgagcggcatgtgcgtgaacgtgagcggcgcatcgcacgcgagcggcgcggcgctgatccagtatccgtgccagggcgcgggcgcgctcaacgatcaattcaatctgtatctgcccgtcgtcgcggccaccaacgtcacggcggcgaacagcaacctctgcgtgagcgtcaatggcggatcgacggccgccggcgcatcgatcgtccagggaacatgctcgaatcagggcgccacgggctggtcgctgctgcccgccggcagcggctatcacgtcgtctcgcaaggcaccgggcaatgcctgaacgtatatggcggatacacgacgagcggcgcgccgatcatccagtatccgtgccagggcgacgcgcagacgaacgatcaatggacgctcgtgcccgtcggctcgaagtaccggctgatttcggtgtcgagcggcatgtgcctgaacgtgagcggcggctcgctgtcgccgggcgcgccgctgatccagtacccgtgccagggcgcgaacgcgctcaacgaccagttctcgctcagcctgccgcagactttcccggtcacgctgccgtccgcatggagccccgtgattccgctgcccgtcaatccgatcggcatcgcgaacgcgccgaacggcaagctcgtgatgtggtccgctgatcagcaattgagcttccagaacgacgtcggcagcaaggcgacgcagacgcagaccgcggtgttcgacccggcgacgaacaccgcgacgcagtatctcgaaacctcggcgggctcggacatgttctgcaccggcaccgcgatgctgcccgacggccgcctgctcgtgaacggcggcgacagcagcccgaagacgacgctgtacgactggacgaccaatacgtggagcgccgcggcgacgatgaacattgcgcgcggctatcagggcgacacgctgctgtcgaacggctcggtgctcacgctcggcggctcgtggagcggcggtcagggcggcaagaccgccgaagtgtggacgaacggcggcgcgtggacgctgctgcccggcgtgcccgagacgaacatcgtcggccccgatccgcagggtatctatcgcggcgacaatcatctgtggctgttcgcgcaaggcaacggcacggttttccatgcggggccgagctcgcagatgaactggatctcgacggcgggcggcggctcgatccagtcggcgggcatgcgcggcgtcgatccgttcagcatcaacggcaccgcgtcgctgtacgacgtcggcaagatcctgaaggcgggcggcgcgaaatcgtaccagcagaacggcagcgtcacgacctatgcgtcgaactcggtgtaccagatcgacatcacgcgcgggccgaaccagccggcatcggtgcagcgcctgaacggcatgacgtaccagcgcgcgttcgccaacagcgtgatcctgccgaacggcagcatcgtgatgatcggcggccagagcgtgccgatgccgttcaccgacacgaccgcgatcatggtccccgaaatctgggacccggcgacgcaacgcttcaacctgctcaagccgatgcagacgccgcgcacctatcacagcacggcgatcctgatggcggacggccgcgtgttcgcgggcggcggcggccagtgcggcaccggctgcgcaatgaaccatctgaacgcggagatcctcacgccgccttacctgctcaacgcggacggcacgccggcgccgcggccggtgatcacgaacgcgccggccacggcgaagctcggcgcgacgatcgccgtgtcgacgcaaggccccgtcgcgtcgttcgtgctgatgcgcctgtcgtccgtcacgcatacgacgaacaacgatcagcggcgcattccgctcgcgatcgcgtcgtccggcggcacgagctaccagctcgcgattcccgccgatcccggcgtggtcctgcccggctactacatgctgttcgcgctcaacgcgcaaggcgtgccgagcgtgtcggcatcgatccggatctcatga

SEQ ID NO: 1131 - DNA, 999 bp, Burkholderia pseudomallei
atggcattcaagattctcagttgcgacggtggcggcatccggggattgatcactgcgttgctcattcaggatctcgatcgacgcagcgggatcctggcgaaggcggacggcttcgccggcacgtccacgggcggcctgatcgccctcgcgcttgcgcgcggggtgtcgatctcggaagtcgtcgacgtctaccggaaccgggggagcgagatattccaggagagcggcgcgtggctcgaacagcgggcgacgatcgcgacggatgcgagcttcgccgcgttcgccgggccggggcttttcgcgtgccagtatgtgaacaccgggctcaagcgcatcgcgcaggaactgctgcgcggcggcgatctgaccgagttgcaccggctgaccgtcatcaattcgtcacggctatgggatccggcgctgcgcagttggtccgcatgcacgttctcgaacgcgagcggcaatgcgtatcgccatgtcgcgctcgtcgacgcggcgctcgcgacgtcggccgcgccttcgtactttccgccgtacgaggtgccttcgctgggctatttcgcggacggcggcctgttcgcgaacaatccttcgatgacggccgtttccgaggcgcttgcgagccgtctcggcggcgagctcggcaatttgcgggtgttgtcgttcggcaccggcatcagtcaggcaggcatccgcccgagcgcgatcggcgatccgctcagatggggcgtgacgacatggttttggcctttcgagagccacgatgtgccggcatcggcgctgctcggtctcacgctcgatacgaccgcgatgctcgcgacgcagcaggcgacgcaattgctcggtggaggctaccggcgcgcgaatttcgtgctcggcgaaacggttgggcttgacgactggcgcaaggcgtcgctgctggagagcgaaacggccgcctacatgaagacgcccgcttgggagggcgtgtgccagtgggtcgatgcgaactggcgctga

SEQ ID NO: 1132 - DNA, 1155 bp, Burkholderia pseudomallei
atgaagaaactcgctctgtctaccctctcgctcgcgctgctgggcgcagccggtgcagctcaggctcaaagcagcgtcacgctgtacggcgtgattgatacgtcgatcacttatgtccacggcaacgacggcaaggccaacaacgcctggctgatgggcagcggcaacctgcaaggcagccgctggggcctgaagggcaccgaggatctcggcgccggcctgaaggcgatcttccagttggaaaatggcttcaactcgaacgacggcacgctcggccaaggcaagcgcatgttcggccgccaggcgttcgtcggtctgcagcatgaccagtacggcacgctgacgctcggccgtcagtacgatccgctcgtcgacctcgtgcaaccggtgacggccgacaactacttcggcagcctgttcgccaccccgggtgacgtcgacaacaacgacaacagcctgcgcgtgaacaacacggtcaagtacacgtcgcccgtgttcgccggcttccagttcgaagccctgtacggcttcagcggcatcgcgggctcgccgggccaaggccagacgtggtcggccgccgccgcatacaacaacggcccgatcggcgtcgcggccggctacttctacacgtcgaacccgtcgccgacggccggctcgcgctcgacgtggagcggctcgtccgacgcgatcttcgacggcgcgatcaacagcggctacacgagcgcgaagtcgatcggcatcgcacaggtggccggccagtacgtgttcggcccggtcacggtcggcctcggctacagcaacgcgcaatacaagccggacggcttctcgggcttctcgtcgaccgagaagtacaacacgggccgcggcttcgtgacgtaccaggccacgccggcgctgctgctcggcctcggctacgcatacacgaaggcgagcggcgacacggacgcgaagtaccaccaagtgtcgatcggcgcggactacgcgctgtccaagcgcacggacgtctacctcgccggtgcgtaccagcacgcgagcggcacgcagcgcgtcgatgcgacgacgacgcaaacggcgcaggcatcgatcggctcgtacggcgtgaacggtacgaagtcgcaagagatggtggctctgggcctgcgccacaagttctaa

SEQ ID NO: 1133 - DNA, 2727 bp, Burkholderia pseudomallei
gtgaacaggaacgtgtttcgtttggtgctgaacagggtggcgggcatgccggtgccgatgccggcggcggaggtgtcgcgcgggcgcggcaagctcggctgcggcggcgtgcgggcgcaacgtcgcggcggtgcggcgtgtgcggcgctgcttggggtggccgggccgtccttggcgttcgcggcggtggtggcggacccgaacgggggcgcgcagcggcccggcatggcgacgacggcgaacgggacggacttggtcaatatcgtcgcgccggacgcgacggggttgtcgcacaacaagttcaacgagttcagcccggttggacgcggcgtggtgttgaacaacagcgtgcggcccggggaatcgcagatcggcggcatggcggcgcagaacccgaacttgatgcaaccggccacccgggcattgctcgaggtgacgcagcaacgcagcgtgctgcagggcacgctggaggcgttcggcggcaagctcgacgtgctggtggcgaaccagcatggagtgacgatcaacggcttgacgacgctgaacgtgggccggctcggcgtgacgacggggcaggtgctgccgcaagcggccgggcagttgcgtttgggcgtgacgcaaggcgacgtgctgatcgaccatgggggcatcgatacccagggcctggacatgttcgacgtggtgagccgcagcatcgccgtgcgcgggccgatccacgattcgagccgcgccgcgggcgccgacgtgcgcctcgtggcgggcgcgacggcctacgatccgcagaccggtcattatgaggcgatcgcggcggacgaatcgaaggcgccggtgcaggagggaatcagcggcgaactgctgggagcgatgcacggccgtcacattgtgctggtgagcacggaatcgggcgtgggcgtgcggcacgacggaccgatcaagtcggcgaacgacattcgggtgagcgcgaacggcgaggtgacgctgggcgggccgcagcaggcggctcaggaggcggttgcaggagcgcaggcggtaggcggcgccggcatgcagaacgtgatcgcgggcggcacggtgagcgtctgcgcgcgtgggcacgtcgcgatccagggcgcggtgaccgcgggacaggatgtggatctgcaggggaaaagcgtgaaggccggccggatgagcgcgcagcgcgacgcgctggtgacggcggcggatggcgtgacgctcgatggtccggtggacgcgaagcgtcacgtgtggatcggagcccacggtgatgtggtgatccgtgaagcggcggcggagcagaacgtggtgctgctggggcgcagcgtaacggccggccggttggacgcgcagcgcgacgtattggcggcggcccgcgacggcgtgacgatccatgaagcggcggccgcggggcaggatgtggtgctgcagggaagcagcgcgagggtcggccagacgagcgcgcagcgcgatgtgctggtgatggcggcagatggcgtgacgctcgatgggccggtgagcgcgcagcgcgccgtatgggtcgagacccaaggtgacgtggcgggcagtgagtggatcaaggccggacgggacgtgcaaatcggcgcggcggcggatctggcgggcgcggtaacggccgaagagatgcagcaactcaaggcccatggtgacgcggcgaacaggcggcgcgtcaaagccgggcggaacgagccagccggcacggcggctgaacgtccggccgcggcggagcagacggtggccgtcgctgacgcgatgcgcgagatcggcgtaggcggcgatcggctgtccggattggatgccgcgccgggtacgccgggtacgcccttcggcgcacacccgcaagcgatgttcgacgatccggcggcgcagattgcgcgatcggctcgatccacggcaacggcgggcggacatgcgggttcgttcatgcgcgtcggagacggtcacatcgccaaaatgaccacgtccagagaggcggagatatacgagaattaccgcttggctcttgccggcgtcatccccgacaccgtgccgcctgaagaggtggattcgcgggtcggtgtcacggccaggcagaggcaggccatggcgactttcaaagggtgggcggagatgaaaggccagcgggttgtcgtcatgcaggcgctgggcgcggagatcgcgccggaggacaagatcgagctggacgtcaagatcggcgccagtacggtgtcgcgcaccgagttgatcggcgccggcaggactcgctggcaggccttgagcaagaaggtgagattgacggcggcggacctgctgcggggctcgcgttcgctggtgggcgacgatcgcggctatacgctcgccggccgcacgagcggggggattgccctggacgcgaggaattcacgcaactccgtcggccgatccagcgaatcgctgattcgcgaggcgctggatcgctcgcccgatacgcgctggcggaacgcgcagcacttgctcgggcagttgcagaccattcgagagaagatgcacgcgttgccgctcaccttcgtcgcctccagcgtcctcattgcaatcgacaaacggaaaccggaaaactcggtcgcccggctgatcgatctcgcgcacccggtgcagcctttcgaaaacgaagcggactatgagaaagtcaatcaccgcttcgaggatggtcttgacaagctgatcagactcttccagcaggtggaaaaatag

SEQ ID NO: 1134 - DNA, 396 bp, Burkholderia pseudomallei
atgcccaaccgattccgcaaactgactgcctggctgggcatgcttgcgatcgcgttggcgatcgtcgcgccgctcgtctcgcaggcgagtgcgcggtccgccgcgccgtcttccggcgcggtgatctgcggggacgagcaccgcgcgcagccggccgaggcgggcatcgcgcacgacggccccgtgcacgacggcgtcgcgcatcacgcgttgcatctcgacgcgtgcggctactgcgcgttcttcgcgcacagcccggcgatcggcgcggccgcgccgtcgctctttgccattcatgtcgcggccgtcgcgccgcccattccctccggggccgccgcgccctcgctcgagcgccacacgcacgcttatccgcgcgcgccgccgacagacgcctga

SEQ ID NO: 1135 - DNA, 399 bp, Burkholderia pseudomallei
atgaagccgctccttttcgccgccgccctgacggcactcgccctcgtcggccccgcccgcgccgccgacgccgcacaagcggccgccgacgcaaaggcccaggccgcggccaacgaggcggccgggctgcccgatctcacgaagatcaaccgccccggcgccgaagtgacttcgaaggtcgatttcaacgacgtgcggcgcacgccgagctttcacgaaaaaagcaagaacggcaccgaagtcaccgaattccgggatcgcggcaagccggtcgagatcaacgtgaaatcgaacttcggcacccgctatcagatgagcgcgtcgcccgatacgtcgccgcgcccgcacgacgccggcgtgcctgtcacgcgcctgccgtcggtcaacctgcactattga

SEQ ID NO: 1136 - DNA, 1875 bp, Burkholderia pseudomallei
atgcgcactccgacgcccctgttcgccgcactgtcgctcctgtccaccgtcgccgccgcgcccgcgttcgcggccgccgcatcgcccgtcagcacgaactgcggcggcagcgcaacgccgatcgccgagattcagggcgccggcgcgccttcgccgctcgccggccagaacgtatcgatcgaggccgtcgtcacggccgatttcggcggcgccgacggcttcggcggcttcttcgtccagcaggccgatccgcagcgccgcaaccagcccggcgtatccgaagggctgttcgtctactcgccgaaagcccgcgcgcgcgcgggcgagctcgtgcacgtgacgggcaaggtcgaggagaaatacgggcagacgcagctcacgctgtcgggcgccgtcgcggtctgcgcgagcggccagtcggtcacgccggcgacgctcgcgctgcccgtcgacagcccgaacgcgttcgccgcgtacgaaggcatgctcgtgcgcctgccgcaaacgctgaccgtcaccgaggtctatgaactcggccgctacggtagcgtgctgctcagcaacgggcgtctgcgcacgccgacgagcgtcgtgccgcccgcgcaggcgaaggcggtggccgaggcgaatgcgcgcaaccggctgatcctcgacgacggctcgaacaagcagaatccggcgaccgtcccgtatccggcgccggcgctctccgccgcgaacacgctgcgcgcgggctacacggccgccgatgtcgagggcgtgctcgagctgcgctacggcgcatggcgcctgcaaccggtgccgggcgcgcgtacgcccactttcggcgcgagcgcgaacccgcgcaccgccgcgcccgcgcgcgatcctcgcgcgaacctgcgggtcgcttcgttcaacgtactgaactacttcaacggcgacggcgcgggcggcggcttcgacgatccgagcaaccggggcgcgaagaactacgaagagttcgtccggcaggacgcgaagatcgtcagcgcgctgaaggcgctcgacgccgacgtgatcggcctgatggaaatcgagaacgacggctacggcccgctgagcgcggtgcgccagctcgcggcgaagctcggcgagaactggcgggtggtggacccgggcagcgcgcggctcggcggcgatgcgatcgcggtcgcgctgatctacgacagccgcaaagtgaagccgatcggcaacgcggcgacgctcgcgatcgacgacaagaaccgtcagccgctcgcgcagacattccggccgctcggcggctcgcgtgcggtgacggtcgccgtcaatcatctgaaatcgaagaactgcccggatgcgacgggcgatgacctcgatcagggagacggccagggctgctggaatgcgacgcgctcgcgcgcggcggcgaagattgccgattggctcgcgcgcaatccgacgggcgcgcccagcgaaggcgtgctgctgatcggcgacctcaacagctacacgtacgaggatccggttcgcacgctcgaatcgcgcggctacgtgaatctcgtgtcgagcaaggtcggctccggcgcatacagctacgtctacaacggcgaggcgggctacctcgaccacgcgctcgcgacgaacgcgctcgcctggcgcgtgaaggcggtgcacgactggcacatcaacgcggacgagccgatcgccctgcaatacacgctcgcatacaagagcgccgaacagcagcgcacgtattacgcgcccgacgcgtatcgctcgtccgatcacgatccggtactgatcgacatcgcgctcgccgacgaatatgcggccgcggcgtcgcgccgaggcgcggagatggcggccgcgcacagccgtcgcccgtggcattga

SEQ ID NO: 1137 - DNA, 2097 bp, Burkholderia pseudomallei
atggatgaccaccgacgtatcgcgccgcctttcgctcgcaggctgcatcccttgtcgctgctgctcgccgcgagcctcgcgcatggcgagacgggcgcgccgcccgccgagcgccgatcggacgcgccgcccgcgacggcgctcgcgccgatcttcgtgaccgcgaacccgctcggcgcgtcggcgctgagctcgcccaccgcgtcgctgtccggcgacgcgctgacgctgcgccgcaccgattcgctcggcgacacgctgaacggcctgcccggcgtgtccacgacgacctatggcccgctcgtcggccgtccgatcatccgcgggatggacggcgatcgcatccgcctcctgcagaacggcgtcgccgcgtacgacgcgtcgtcgctgtcctacgatcacgcggtgccgcaggatccgctgagcgtcgagcgcatcgagatcgtgcgcgggccggcggcgttgctgtacggcggcaacgcggtcggcggcgtcgtcaacacgatcgacaaccggattccgcgcgaagcgatcacgggcgtctcgggcgcgctcgacgcgagctacggcggcgcgaacaatgcgcgtgcgggcgcggcgctcgtcgaaggcggcaacggccgcttcgcgtttcatctcgacgcgttcggccgcgagaccgacgcgctgcggattccgggccatgcgcattcggcgcgccagcgcgcgctcgacggcgaggacgccagcgagccgtacggcaagctgccgaacagcgacggccgccgttacggcggcgcggcgggcggctcgtacacgtgggcggacggctacgtcggcgcatcgtacagcggctacgaatcgaactacggctccgtcgccgaaaccgacgcgcggcttcagatgcggcaggagcgcgtcgcgctcgcgtcggaggtgcgcaatctgcgcgggccgttctcgcagctgaaattcgacttcggctacacgaattaccagcataaggaaatcgaggacggcgtgacgggcacgacgtttcgcaatcacggctacgaggcgcgcgtcgaggcgcggcaccgcaagctcggcccgttcgaaggcgcgctcggcgtgcaggtcggacagaacacgttctccgcgctcggcggcgaggcgctcgcgcctaccacgcgcacgacgagcgtcgcgctgttcggcctcgagcagtggcaggcgaccgacgcgctgaagctgtccgccggcgcgcgcatcgagcacgtgcggctcgatccgagcgcgaacggcgacgacaagttcggcttcgcgcgctcgcgcgatttcaatgcgggcagcgtgtcggcgggcgcgctgtatcagctcgcgcccgcgtggtcgctcgcgggcaacgtgtcgtacacggagcgcgcgccgaccttctacgagctgtacgcgaacggcccgcacggcgcgacggggcagtacctgatcggccggcccgatgcgcagaaggagaaggcggtgtcgaccgatctcgcgctgcgctatgcgagcggtccgaaccgcggcagcatcggcgtgttctacagccgcctgcggaactacctcgccgaatacgacaccggacggctcgtcgacgacgacggcgtgcccgtggccccgggcgccgacgacgcgctgcgcgaggccgtctatcgcggcgtgcgcgcggagttctacggcgtcgagctcgaaggcaggtggcgcgcgttcgagcggcgcgggcatcgcgtcgatctcgagctgagcgccgactacacgcacgcgcgcaacgcggacacgggcgagccgctgccgcggatcgcgccgctgcgcgcgacgctcgcggccgattacggctacggcccgttcggtgcgcgcgcgcagctcacgcatgcgtgggcgcagcatcgcgtgcccgagcacgatctcgcgaccgacggctacacgtcgctcggcgtcgtgctcacctacaagttgcgcgtcggcgcgacgaactggctcgcctatctgcgcggcgacaacctgacgaaccaggacatccgctacgcgagctcggtggtgcgcaacatcgcgccgcagggcgggcgcagcgtgagcatcgggatgcgcacgacattctga

SEQ ID NO: 1138 - DNA, 2865 bp, Burkholderia pseudomallei
gtgtatagacgtttcctgctcgttgggatgacggcgctcgcgctcgcggcgtgcaacagcgattccgtcgatacgcccgcgctcggcgacacccgcacgacgctgcttgcgacgggccagttgatttcgcccgcggccgcacccggtgccgcgttcgtgccgctgaatccggggcttgcggatgcgccgggttacatcgcgggccaaccggtttcggaggcgctcagccccgaccgcaagacgctcctcgtgctgacgagcggctacaacaacgtgctcgacgcgaacggcaagatgatcaagccggattcgaacgaatacgtgttcgtgttcgacgtgtccggcggcgcgcccgtgcgcaagcaggtgctgcaggtgagcgatacctacgtcggcatcgcgttcgcgccggacggtcagcatttctacgtgacgggcggcggcgacgacaacctgcatcgcttcgcgttctcgcagggcgcgtggggcgaggtgggcgcgccgatcgcgctgaatcacaaggcgggcaacggcatcggcagcacgccgcttgcgacgggcgtcgacgtgacggcggacggcaagcgcgcggtcgtcgcgaatcgctacaacgattcgatcacgctcgtcgatctcggcgcgggcgcggtgctcgccgagcgcgatctgcggccgggcaagagcggcggcgcatcgggcgcgccgggcggcgagtatccgaacgcggtgcgcatcgtcggcaacaagacggcttatgtgtcgagcgagcgtgatcgcgagatcgtcgtcgtcgatctgtcgacgaacgcgccgcaggtcgtcacgcgcattcccgtcaagggcaatccgaacaagatggtgctgaatgccgcgcagtcgcgcctgtacgtggcgtccgacaacgcggacctcgtgtcggtgatcgatacggccgcgaacaaggtggtgtccaccgtgtcgacggtcgcgccggcgggcctcgtcaccgagatgcagtatcgcggcgcgtcgccgaacgggctcgcgctatcggccgacgagcgcacgctgtacgtgacgaaccgcggcacgaacgacgtggcggtgatttcgcttgccggcgcgtcgcccgccgtcaccggcctgattccgaccggctggtatccgtccgacgtcgcgctcggcgcgacgaacgcgatgtacgtcgtctacacgaagaacatgccggggccgaatccgggcaactgcaaggacagcggtcgcacggtgccgtgcccggtgaagaacacgccggtgaagctcgtcgagaatcagtacatcgaacaactgagcaagggcggcctgatgtggatgccggcgcccggcagcaagacgctcgacctgttgacgacccaggtggcgaacaacaacagcttcaacgcggcgctcacgccgaacgacatcgcgacgatggccgcgctgcgcaagaagatcaagcacgtgatctatatcgtcaaggagaaccgcacgtacgaccagattctcggcgacatcggccgcggcaacagcgatccgtcgctcgcggagtttcccgacgcgacgacgccgagcatgcacgcgctcgcgaagacgttcgtcacgctcgacaacttctacgattccggcgacgtgagcggcgacggctggccgtggagcacgggcgcgcgcgaatcggacgcgggcgcgaagatgctgcccgtcaactacgcgaacagccccgcgcgcgccggcgcgcgcggcggctcgtacgactgggaaggcgcgaaccgcaacgtcaacgtgggcctgacgggcgcgcaacgcgcggccgcgaatccgtcgctgccgtccgatccggacctgctacccggcaacgccgacgtgtcggctcccgacggcccgtccgacgcggttcagcagggctacatctggaacgccgcgctgcgcgcggggctgacggtgcgcaactacggcttcttcgcggatctcgcgcgctacagcggccctggcgcgatcgcgccggatcgcacgccgttcgtcgatcacgcggtgcaaacctatgcgacgagccccgcgctcgtcgatcgcaccgatccgtatttccgcggctatgacaacgcatatccggatttctatcgcgaactcgagtgggagcgcgagttcaacggcttcgtcgcgaacggccagatgccgtcgctcacgctgctgcgcctgccgcacgatcatacgggttcctattcgagcgcgctcgacggcgtcaacacgccggagatccagatggccgacaacgactacgcggtcggccgcgtcgcgcaggccgtcgcgaacagcccgtatgcggccgatacgctgatcttcgtcgtcgaggacgacgcgcaggacgggcccgatcacgtcgatgcgcatcgcagcacggcgttcgtgatcgggccttacgtgaagcagaacgcggtcgtcagcacgcactacacgacggtcaacatgatccgcacgatcaccgaagtgctcggcctcgatcacttggggctgttcgacgcgacgcaaggcccgatgaccgacgtattcgatctgaaccagtcgaagtggagcttcaaggcagtggcgtccggcttgctcgcgaacacgcaactgccggttccgtcgggcgacatcaagacggcggcgttcaagccgacgcacgggatgcgctactgggcgctcgcgacgcgcggcatggatttctcggtcgaggatcggctcgatgcggttgcgtacaacaagctgctgtggaaggggttgatgagcgggcgcgcgtacccggtgcgcgtcggcgagcgtgcggcgccgcatcgtcgcgacgacgatgacgacgtgaaggtgtcgcaggcgaggagcgcggcgcacggatga

SEQ ID NO: 1139 - DNA, 1257 bp, Burkholderia pseudomallei
atgcatgcgtttcgttgccgacgcggcccgcccgttcctctcgccatcgtggcgctcgcgtgcgcgtgcgtattcggcgcgccgcgcgcgagggcggctgccgctcatgccgacgcgccggttgccgcgtcgatcgcgtcgttcgagcccgccggcgggccggccgctgcggcggacgccgccgatacggccgtgatgcccgcgccgcctgcgtcgttcgcgccgcctgctgcgccgcccgtgccgcaggttgcgtcgcttgcttcgtctgcatcgactgtgccgacaaccccgacagcgacgacagcaccgatcgcgtccgcaccggccgccacgcccctttccgcgccgccgctcgcaccgccggccgccgcaccgccggccgccgcaccgctcgtcatcgttccgcgccgcttcgacgacacggcgctcgtgaaggtcgactcggaaggcatgcccgacggctggtcgctcgccgaggtcgcgccgaaccaggaaaaccagccggcgctgccggaggcgctcgtcgcgcacgtgcaggcgccggcgcagcggcacaccgagctctcgctcgcgtattcgatggcgcacctgacgaacggctatggcgactggtacggcgtgcacctgcgcgggctctatcaggcgggcggccgcacgatcatcggcgagctcgcgcaactgcaccgcttcaacgaaagcacgcagctcggcgcgatcacgtacatccaggacatggggccggactggttcggcggcatcgggttttccggcacgacgtccggcacgatcctgccgagcgcgcgcgtcgatctgtcgctcaaccgcaagctgctgtcgaatcgctcgctcgtgctgtcggcgggcgcgggctacgcgtggaaccgcaacggccaccgcgatcagctctaccacctcggcgcgatctggtatgcggtgccgaagtggatcttcgaggcgggctggaactacacggtcgattcgccgggctcggtgaaggcgcccgcctactacggcgcgatcacctacggcgaggtcggcaagagcctgatcgtgctgcgtggcagcttcggccgcgaggcgtatcaggcgaccggaaacaacgcgcagatcaccgatttccgcagccacgaggtgtcgctgaagtggcgctactgggtcacccgcaagtggggcacgcaagtcgagttcgattactaccacaacccgtactatttgcgcatcggcggcgaagtcgggatgttctaccggtggtga

SEQ ID NO: 1140 - DNA, 420 bp, Burkholderia pseudomallei
atgcaagagaacctggacgcggactacttcaaccggttcggcgccgactatctgccgggcctgctcggcgtcgtcgtcaagcaggtcgagaaaaaccacgtgctcgccgagctgacgatccgccaggccgtgctcgcgcacggcattctgcatgcgggcacgatcgtgagcctcgccgataccgcgtgcggctacggatgcctcgcgagcctgccggagggcgcgtccagtttcagcacgctcgagctgaagagcaatttcatgggcaccgcacgcgacggcgtgatcgtctgcgacgcgcgcgcgatccacagcggccgcacgacgcaggtctgggacgcgaccgtccggcatcgcgagacggacaagctgctcgcgacgttccgctgcacgcagatgatcctctggccgacgaagtaa

SEQ ID NO: 1141 - DNA, 1770 bp, Burkholderia pseudomallei
gtggcatcaatcatgactattaagcggttgccgatcgcgccattgtcagctttggttatgttctctgcgcaggcacaacagatccccactccgaacgaccaagccgccgccgcccgtgccaatgccgagcagaatcagcaggcgcaacagcgccgtgacgcccagcagcgcgacgccaccgtgcaagcgccgggcgtgcgctcggacgtgccgcgcccggaagcctatccggtactgccgaccgaaacaccgtgctttcaaatcgaccgcttcgcactcgacgtgcccgactcgttaccggccgcgtcgaaggcgcaaggcgcgtcagccttgccgatggatcgcttcgcctttgcacgcgactggcttgcgcactacgccggccaatgcatcggtaagcaaggcgtcgacctgatcgttaaggggctgtcgcaagccatcctcgctcgcggctacatcacgacccgcgtactcgtgcccgagcaggatttgtccactggcgcgttgaagcttgccctgattccgggcgtgatccgccacgtgcgtttcgaggacgagaagttgctcggaacgtggaagaccgctttcccgacgcgcgacggcgacgtgttgaacctgcgtgacattgagcaagggcttgagcagatgaagcgcgtgtcaagccaggatgtgtccatgcggatcgcaccgggtgacatgcccggcgaaagcgatgtcgtgctcgacgtgaagcgcggcaagccgtggacggtcgtcgcgtcgatcgacaattccggcacgcgcgcgaccggcaaactgcagggcaacgtatcgcttggcatcgacaacccgctgggcctgaacgacattttcaacgtcggcttcaaccaggatctggaattcggcgataagcgcttcggttcgcacggctggaacgcgttctattcgattccctggggctactggaccggcacgctttcggcgtataccagcacgtactttcaaccgctcgcggccgtgaatcagacgtttgttgccagtggcaacatgaagacggtcgacttcaggctcaatcgtgtgctgacgcgcagccggaacgatgtgttgggcgcgcaggttcgcttgacgcggcgcttcggcgacagctacatcgaaggcacgacgataccgtcgtcgcaccagaacgcgacctttctcgaattcgggttgaacgaccggcactatttcggctcgtcgcagttcgatggctcgcttgcctatcgtcaggggctcggctggctcggctcgaccgacagcatgttcgcggcagagggagggcagacgtaccgattcaagatggtcgtgctcgatgcgaacctatcgacgccgttcgtcatcggcacgcagccgttcaaatacgtgacgacctttcatggtcagtacaccggcaacacggtttcatatctcgatagcgtgacgatcggcagccgttataccgtgcggggattcgacggtgaaacgctgctggcgggatcgcgcgggttttactggcgcaacgaattgcaggtccccgtcgcgcagaccgggctatcggcctatgccggtctcgactacggtcgggtctggggaccggagccggtcgcgctggtcggcacgcagctcgcgggcgcagtgattggcgtcaagggcagcttgatgacgcgcttcggcgggtatggctacgacctgttcgctggcacacccgtctacaaaccgtccgggtttcccaccgcgcgcgtgacggtgggctttcagctcacggcgcaattctga

SEQ ID NO: 1142 - DNA, 9312 bp, Burkholderia pseudomallei
atgaacaagaatcgctatcgggttgtcttcaatcgcgcgcgcggcgcactcatggtggtgcaagagaatggccgtgcgtcccacggtagcggcagccgcgacgcgagcgcgggcgtcgtccctgcttggctgtcgctctcgccgtttgcgttgcgccatgttgcactcgcggtactggttgcggccggcgtggtgccgatatgggtcaatgcccaggttgtcgcaggcggcgcacacgccccgtccgtgatccagacacagaatggacttcaacaggtgaacatcaaccgccccggcgcgtcgggcgtgtcgatgaacacgtacaaccagttcgacgtacccaaacccgggattattctcaacaactccccgattaacgtccagactcaactgggcggcattatcggcggcaacccgaatttccaggccggcgacgcggcacgtctgatcgtcaaccaggtcaacagcaacaatccgagttttatccgcggcaaagtcgaaatcgggggcgcggccgcccagctcgtgatcgcgaatcaggctggcttggtcgtggatggtggcggcttcctcaatacgagccgagccacgctgacaaccggcaatccgaacttcgggcccgacggctcgctcacgggtttcaacgtcaaccaaggcctgatttcggtggtcggcgcggggctcgatacggccaatgtcgatcaggtggatttgttggcccgcgccgtacaaattaacgctaaggcttacgcgaagaccctgaacgtggtggctggatcgaaccaagtcgactacaacacgctgaacgccacgccgatcgccgccaacggtcccgcgcccaccatcgcgatcgatgtgagccagcttggcggaatgtatgcgaatagggtctttctcgtctcgtcagagaatggcgttggtgttgccaatgccggcgacatcgccgcgcaagccggcgacctgacgctgcaagcgaacggccgcctcgtcctgtcgggccacaccaatgcggccggcaatatgtcgctgtcagcctcgggtggcattcagaacagcggcgtcacgtatggcaagcaatcggtcacgatcaccacgggcacggacctgaccaacagcggcgcgctgaccgcccaacaaaacctgaccgctaacgtcggcagcctcaactcgacgggcacgctcggcgcaggcatcaacgtcgacagcacggtcagcacgagcggcgatctgaacgtcacgagcagcggccagttgaccgcgacggggaccaacagcgcggctggcaacgcgaccttcaccggtagcggcatcaatctgtcgaacagcgcaacggccgccaacggcaacctcgcgctgagcgcgacggcgggcgatgtgaatctggccggctcgactgtcagcgccaagggcgccgtgaacgcgcaggcgagcggcacggtcatcaacgaccggggcaatctgtccagcggcgcgggcatgacgcttggcggcggcagcctgtcgaaccagggcggccgtgccaattcgcaaggcccgctgtcggtgcagatggccggcaccgtgtcgaaccaaaacggcatgctgagttcccaaagcacggccgacgttcgcgggagtgcgatccagaacaatgccgggctgattcagagcgcaggcaagcaaacgattgctggcgcatcgatcgacaattcggcaggccggctgatttccctgaacgcagacggcctgtcggtgacggcaaccggcgcactcacgaacgcggccggcgcgaacgtgagtggcgatccgggcggcgtcatcggcggcaagggcgacgtgaccgtacaggggaacacggtcacgaacagcggctcgatgtcggccgacgcgaacctgcacgtgatcggccagagcgtcgacaacggtaatggcgcgctgcacgccggacagactaccaccgtcgacgccggcaatcatctttcgaatgccggcggccgggttgagggtcaaagcgccgtgttgaacggcgcgacgctggacaactcccagggcacggtcaatgcggcgacggtctcgctgaacggcacgacgttgctgaaccacggcgggacggtcacgcagaccggcaccggcccgatgacggtcgcgattaccgacaccctcgacaactcgaacaacggcctgatccagacgcgcagcacggatctgtcgctcacgtccactaccctgatcaacgacaacggcggcacgatcacgcacgttggcccgggcacgctgatggttggcaacggttcgggcacggtcagcaacaaagcgggcgccatcgccagcaacggccgaaccgtcctgcaaggcaagacgatcgacaactcggccggttcggcgtccggccaaacgggcctgagcgtcaacgccgccgactcgattacgaatctgggcggcaagctcacctcgaacgccaacgtcgacgtgaccgcaggtggagcactggtcaacgacggcggtgaactcggctcaaagacggcagcgacgacgattcatagcgcctcgctctcgaatctgaacggcaagatcgtctcccccactttgacggcaaccgttgctggcttgctcgacaacagccagaacggcgacttcgaagccaatcagcttgcgttgacggccgcgaacctgaaaaaccagggcggccacatctcgcaatggcagagcggcccgaccacactcgccgtctctggcacgctcgacaattcgaacggcggcgtcatccagacgaacagcacggacctgacgctcgcgccggccgttctggacaactcgaaaggcaccatcacgcacggtgggaccggcacgctgacgctcacgcccggcaacggcgcgggagccttgcaaaatactggcggcacgatcggcaccaacggacaggccatcgtgaaggccggcagtctggacaatggtagtggggtcatcgccgccaaactgggtctgtcggccacgatcgccggggcgatgaacaatactcagggtctgatgcgctcgaacgcggcgctgtcgatcatcggcaacggggcactgtcgaaccaccaagggcacatcgaggcgggcacgcccggcgacacgagcacgctgtcgattcaggccgcttcgatcgacaacaccgatggcgcggtgcacgacttcggcacgggcaagatgaccgtgcaaggcggcagtcagatcgtgaacagccacgcgggcggcgtcgacggcatggggcagatgaccggccagggcgacgtgacaatcggtgcggcctcgatctcgaacacgcagggcggccagttgatgggcgcgaacctgctgattcaaggcgctacgctggacaactccggaggacaggtcggcaacgtcgcgaacgccacgggcgacgtgaacgtcgcgatgtcgggcgcggtgacgaataccaacgggtcgatcacctcgacgcgcgacctgtcggtagcggcttccacgctgctcggcggcggcgcatacagcgcggcgcgtgacgcggcgattaatctgcaaggcgacttcacgacgacgccgcaaacgcagttcaacattggtcgcgacctgacgtttaccttgccgggcacgttcgccaacagcgcgaacctgcaatcggtccataacctgacggtcaacgccggcaacatcgtcaacacgggcgcgatgacggcaggcagcctgctcagtacgcattcgggcgacctgacgaactatggcgcgatggtcggcggcagcgtcgccatccaggcgagcggcacggtgtcgaacctcggcccggtcgcgctgatcggcgcatcggacacgtcgggcctgctggaaatcgtcgcgcacgacatcgagaaccgcgacgacacgacgttgggcgattcgatgccgaccacgacgatcttcgggcttggcaaagtggctttggcgggcggcaaggacgcgaacggcaactatacgaacgcagcgctgatcaacaattcgtcggcggcgatccaatcgggcgcttcgatggaactgcacgccgacaaggtcacgaacacgcggcgcgtgatgcagacctcgggcaacacgagtcaggtcgatccggcattgctgcaacagctcggcatcagcatgtccgggtgcgccgcctactacattgcggcctgtagtggtcaggacgtgcactggatcaacctgttccacgatccgaactaccccgattacgatcccgcgccgatcattgccgcgctcaaattgcagccgggcggggtctttaccgttccaccgaacggtggccaatggaacagcgggtatcaatacacgacctatgagggcaaggcgaccgccaacaccgtgacgaagctgagcccgggcgcgcagatcgcatcgggcggcgatctcgacgcgtcgacggtcaagacattccagaactactggagcagtgtgacggcggccggcaacatcaagcagcccgcgagcctcgacatggacggctggggcgcgacgggtcagcaggcgccgggcgtgacggtcgtgtattccggctactaccactacaacaactacgacaactcggaacacaactggaccttgccgttcggcgacaagccgttcgtcggcggaccaggcggctatacgcaggccgcgccggccgatgtgcggcaatacagcttgcccgactatcgctcgacgtggggcgcgaacggcacgatctcgggcaacggcgtgagcgtgaacaacacggcggccaatgcgaccattccgtcgctcggcctgctgcccggccaggccgtgccggggctgacgatcggcacggtcagcggcaacgcgagcggtacgcagtcgggagccgccgcgatcaagggcggcacgcccacctgggtcgatccggtgatcgcgagcgcgacggccgtgaacgtgttgagcaacctgacgattccgcaaggcggcctgtaccgaccgaactcggcaccgaacccgacgtacctgatcgagacgaaccccgcgttcacgcggatgaacaatttcctgtcgagcgactattacctgaaccagatcggcgtcaacccgctgacgacagaaaagcgcctcggtgacgggttctacgagcagcagctcgtgcgcaaccaggtcacgcaactgacgggcaaggcggtattggggccgtatacggacctccagggcatgtatcagtcgctgatgctcgcgggcgccgaattgtcgaagtcgctgaacctgccgctcggcatgagcctgtcggcgcagcaggtggccgcgctcacgaccaacgtgatcatcatgcagaccgagacggtcggcggccagcaggtattggtgccggtcgtgtatctggcgaaggccgatcagcagaacgcgaacgggccgctgatcacggctggcaatatcgatttgaagaacacgcaggtcttcacgaacagcgggaccgtgaaggcggacacgacgcttgcgcttcagggcaagcagatcgacaacgcgttcggtgcgctgcaaagcggcggcttgacgtcgctcgacacgacaggcaacgtggatctcacctcggccaatgtgaaggccggtagcctcgacctgaacgcgggcaacaagctgattctggatacggcgacgcagacgacgcaccaggtcagccgcgacggcgcgacgagcgacaagacgacgctcgggccggctgcaaacctgaacgtggctggcgacgcgtcgatcaagaccggcggcgacttccagcagaacgcgggcaacctgagcgtcggcgggaacctgaacgccaatatcggcgggaactggaatctaggcgtgcagcagaccggcgaacacaaggtcgtgcagcgtgcgaacggcgtgtcggatacggacctcaacagcgcgaccggcagcaccgtgaacgtcggcggcaagtcggccatcggtgtgggcggtgacttgacggcgcaaggtgcgcggctcgacttcggccaaggcggcacggtcgcggccaagggcaacgtgaccttcggtgcggcgagcaccacgtcgaccatcaacgccaacagctcgggcgaccaggggaatcgcagctatgcggaaacccggcatggagcggaccaggcgctgacaggcacgaccgtcaagggcggcgatacgctgaatgtggtgtcgggcaaggacatcaatgtcatcggcagcacgatcgacctgaagaaaggcgatgcgaacctgctggcggccggcgacgtgaacgtcggggccgcgaccgaaacgcacgtgtacaactcgcgcgagacgcatagccgcagtggcgtcgtgagcggcacgaagatcgccagcagtcaggacgcgaccagcaccgtcgcgaacggcagcctgatttcggcggacggcgtgtcgatcggcagcggcaaggacatcaatgttcaaggtagtacggtcgtcggtacgcacgatgtggcgctgaatgcggcgcacgacgtgaacataacgacgtcgcaggacaccagccaatcgtcgaccacctatcaggaacagcactcgggtttgatgtcgggcggcggtctgtctttctcggtcggcaacagcaagctcgcgcagcagaatcaatcctcgagcgtcacgaacaacgccagcacggtcggctcggtcgacggcaatctgaccgtcaatgcgggtaatacgctgcacgtgaaaggcagcgatctggtcgcgggcaaggatgtgaccgggacggcggcgaacatcgtcgtcgattcggccaccgacaccacgcgtcaagcgcaacagcagcagacgagcaagagcgggctgacggtcggcctgtcgggctcggtgggcgatgcgatcaacaatgcgatcagcgagacgcaggccgcgcgcgaatcggcgaaggatagcaacggccgcgcatcggcactgcatagcatcgcggcggccggtgatgtggcattcggcggtttgggggccaaggccctgctggacggcgcgaaggggccgcaggccccgagcatcggcgtgcaggtcagtgtcggttcgagccatagttcgatgcagtcgtcggaggatcagacgattcagcgcggctccagcattaacgcgggcggcaatgcgaagctgatcgcgacgggcaacggtacgccgaaggacggcaacatcacgatcgcgggctcgaacgtgaacgcggccaacgtggcgttggtcgcgaacaaccaggtcaatctcgtcaacacgaccgatacggacaagacgcagagttcgaactcgtcgtcggggtcgagcgtcggcgtgtcgatcggcacgaacggcatcggcgtctccgcatcgatgcagcgcgcgcacggcgacgggaattcggacgcggcgatccagaacaacacgcacatcaacgccagccagaccgcgaccattgtcagcggcggcgacacgaacgtgatcggcgcgaacgtgaacgcgaacaaggtcgtggccgacgtgggcggcaacctgaacgtggcgagcgtccaggatacgaccgtaagcgccgcgcatcagtcgagcgcgggcggcggcttcacgatcagccagaccggcggcggggctagtttcagtgcacagaacggccacgcggacggcaactatgcgggcgtgaatgagcaggcaggtatccaggccggctcgggcgggttcgacgtgaccgtgaggggcaacaccgacctgaagggcgcgtatatcgccagcacggccgatgcgtcgaagaacagtctgacgacgggcacgctcacgacgagcgacatcgagaaccactcgcactacagcgcgaacagtgcgggctttagcgctggcgcgtcagttggggtaagcaccaaggcagttgggccgtcgtcggtatcgggttcgggtggcgtcacgccgatggtgttccagaacgacagcggcgaccaaagcgcgacgacgaagagcgcggtgagcgccggcacgatcaatatcacgaagccgggcgagcagacgcaggacgtcgcgaacctgaaccgcgacacgacgaatctgaacgggaccgtttcgaagacgcctgatgtacaaaagatgctgtcgcagcaggctgacacgatgaacgccgcccaggcggccgggcagacggtgtcgcaggcgatcggtctgtatgccgaccacaagcgcgacgcagcattggacgcggctgacaaagcctataaggctggcgatttggcgggcgcacaggcggcgttgaacgaagccaagggctggatggaaggcggagcgtcgcgcgcggaattgcagatgggcggcggtgcgttgatcggcgggctcggcgggggcagcgcgcttacggcgatcggtggggcagcgggagccggcatgtcgtcactgctggcgaaccaggcagagaagatcagtaagtcggtgggtgatacgaccggctcgtcgctggtcggcaacatcgcggcgaacgtcgcggcaacggttggtggcgcactggtgggcggtagtgcgggcgcagcgatggcgtcgaatgtgcagctttataatgcaggtaacgattcgaacaatcaaacgtcaaacgacgtctttgcatcgttgtcgaagaaggttgctcaagccatcgccatgacggcagatggcaaggccggtgtctggaacggaatggtcaacgtcgcgggcgtgatcgttaatcttccgaacggcgggcccttcgcgtcgcccggcgatccgggttatgtctcactcgatgggttgaagaaaccctacaagtctggaacatcgattgggcctgacgcggagttctggacacctgtcctggcgacactgggtctcggaggcaaagcggcagccggaactggtgcgacaacaacatcggcggatgcggccacggttggaaacggtgcgctcaaaaccgccagtggagacttgagcgcagccggcaatgcggcaagaacccaaccgtatggcaatggcgcaagcgcgtcgccctcgccgggaacggcgacagcggggagttcgggagcgaatgcgcaactcccaacggccaatggtggagttgcggcggcgggtacatcatcggccacaaacgtgggcaaggttgttatcgacggcaagatcggcggccaacttgaggctcgtggatggacgcagcaagaagtgcaagcagtcgtcaatgagggacctgtcggaacgacgatggacaatcgatctgcggggaagaccccagacgggttgccgagaaatgattccgcatccgtgtacggttctaagagtggttatgttgtggtcaacgaccggaccggcgaagttgtccaggtgagcggtaaaaacgatcctggttggattcccgatagtcgaatcaaatggaagtga

SEQ ID NO: 1143 - DNA, 1443 bp, Burkholderia pseudomallei
atgaagagggtcgcgcgggcggtcgtgctcgcgtggggactgccgatgctcgccggcgtatcgattgccggcgccgcgcgcgcggacgatgcggcgcccgccgcgccggctcaggcgccgttagccgcgacgctcgcgcagcaggcgacgacgccgaacgcgctcgtcaatgccgacgccacgcaggcggtgctgccgcagccgccgatgtcgagccaggcgaaatcgaagggcttcattgccgacagccatttcgacgtgctgttgcgcaattacgcggacgtgctcgatgcgaagggcgggccgcatcgtcacgcgtgggtccagggcgtgatggcgaacttcgagtccggctatacgggcgggctgatcggcttcggcgtggacgcgtcgatctacgcggcgctgaagctcgacggcggcgcgggcggcggcaacatggtgcacgtcgcgaagggcggcggcggctcgaaccagctcgcttgggcgttccccggcatctatgacgtgaaggcgcgcatctcgaacaccgtgatcaagtacggcctgcaggcggtcgacaatccgttcatggagcagcacgacaaccgcgcgctgccgccgacgttcctcggcgcgacgatcgtgagcaacgaattcaagaacgtgatgctcgaggcgggcagcttcacgaagaccaacgcgcgcggccatacgacgctcacgaacctgacgacgcaatacggcggcacgcgcgtcgaccgcttcacgtacgtcggcggcacgtgggattattcgcagacgggctcggcgtcgttctacgcgggccaggccgacgatgtctggcgccagtactacggctcggtcaagcaaagctacggctcgccgcagacggtcaagtggacgggcttcggcaatttctattcgacgcacgacacgggcgacgcgcgccagggcaagatcgacaacaacgcgtacagcctgtcgctcgccgcgcagcacggcccgcacgagctgctgctcggctatcagcaggtgctcggcgaccagttcttcgattacctgaacgaaacgaacggcatcttcctcgtcgattcgatggacgtcgactacaacgcgccgcacgagaaatcgctgcagctgcgctacacgttctacggcaaggaggcgggcctgcccggcttcaaggcgatggtgtggggcgtgacaggctggggggcggacggctccgcgagcgcggcgctcgatccgacgcgctcgagcatctactggaaggacggcgcgccggtgcagggccgccatcacgagttcggcttcatcccgtcgtatacgatccagagcggcaagctcaaggacacgaagatcacgttcatcgcgatgtggcacgtgggttcggcgcactactcggacagtaccaaccaggaataccggctggtcgtgaacgtgccggtgaaggtgttctaa

SEQ ID NO: 1144 - DNA, 1080 bp, Burkholderia pseudomallei
atggacaaacgactgtccgcgctttgcggactgggcctcgcctcggccggcgcatgcgcgcaaacgagcgtgacgctttacggcgtcgcggacgcgtacgtcgagtacgcgacgaaccaggcggacgcgaaaggcgagcccgccgcgctcgcgcgaatgggctcgggcggcaagagcggctcgcgctggggaatcaagggcactgaagtgctcggcggcggctggcgcgccgcgttccggctcgagagcggcgtcaacctgaacaacggcgccggcacgggcgcgggcggcttcgaccgctccgcgtgggtcgggctcgagcatccgcgctggggcgcgctgcgcttcggtcgccaatacacgacgatgttcgacatcatggagcactactcgccgacgggcgcgtattcgacgctgtacgaacctgacggcgcgatcgtcggcatcagctttcgcgagaacaacgtcgtcaaatatctggcgacggccggcccgctcacgttcgaagcgcactacgcgttcagcaacgaaccgggcgcgttccaggcgagcgccgcgcacggcgcgggcttcgagtacacgggcggcgcgctgtcgttcgcgttcgcatacgacgacgtgcacacgccgcaagccggcggcttcgcgcacttgcgccgctacgcggccgccgcgatgctgaccgtcgaggcgacgcaactgatcgcgggcgccgcgcacgggcaaggcaacgtcgcgacgccatcggtcgtcacgcgctacacgttctggtggatcggcgtgcgtcaggcgatcacgcccgtcgttcaactgatcggcgcgctgtatgcggagcgcgtgcgcgcgcaaaacccggcgagcccgcccgccgcgcgacatgcgtcgggcacgccgcagcaggcgacgctgcagttgaactacttcgtctcgaaaaccacgacgctgtacgcggcaaccggttacgcgcgccacgcggcgctcgatttcgacaactataactacggcttcctccactactcgctcgccggcgcgcgcgccggcagcgcgggcgtcgccgtcggcgtgcgcaagttgttctga

SEQ ID NO: 1145 - DNA, 171 bp, Burkholderia pseudomallei
atgtccagcctcgttcaatacgtcaagcagttcgttcgcgatgaaggcggcgtcagcgccatcgaatacggcctgatcgctgcgctgatcgcgatcgtgatcatcggtgcggtgaagacggtcggcaccaacctcaactccgtcttctcgacgatcggcaacgatctgtaa

SEQ ID NO: 1146 - DNA, 219 bp, Burkholderia pseudomallei
atgagaacccagtcctttagccggaagtcgccccgtgcgcacggaatcggcgcacgtcccgctcgcgcgttcatgcgctggctgcgtgacgaatcggcggtgtccgcgatcgaatacgcgctgatcgcatcgctcatcgcgatcgtgatcatcggcgcggtgcaggtcgtcggcaccaatctgcagtcggtgttcagcaccgtcgcttcggatgtgtga

SEQ ID NO: 1147 - DNA, 1191 bp, Burkholderia pseudomallei
gtgtcgattctcgtcgcgctgatgctcgcggtgctgatcggcttcgtcggcctcgcgctggatctcggcaagctctacgtgacgcgcagcgagctgcagaacagcgcggacgcgtgcgcgctcgccgcggcgcgggatctgacgggtgccatcaatctgtccgtgccggaggcggccggcatcaccgccggccacctcaactacgcgttgttcgagcagtttccggttcagatgcagacgaactcgaacgtcacgttcagcgattcgctgagcaatccgtttcaaccgaagaacgcgatcgcgtcgccttcgtcgatcaagtacgtgaagtgcacgacatcgcgcacgggcatcgtcaactggttcatccagacgctcaacctggtgccgggcgtgaccgtgacgaacgcgtcggtgtccgcgacggccgtggcgaccgtcggcgccgcgcagaccacctgcgcgattccggtgttcatctgcaaggccggcacgcagacgagcccgcccgtggccggcgcaacctacaacatcggcgactggctctccgcgaagacgggctcgccgccgtcgttcggcgcgggcaacttcggctggtcggcgctcgacggctcgaacagcgcgtcgtcgatcgccaacgagctgacgggcaattactgcgcgctgcccgccaccggctcgcaggtcggcacgcccggcgacaaggcggcgacgaccaacgcgtacaacacgcgcttcggcatctacgcgaatccgtacaaggacccgtcgtacggcacgcccgacttcaccggcttcgcctacgacgcgaccacatggccctcgcagagcaacgcgtattcggacttcgtcagcaagcgcctgacgttcgcgagctatcagggcgacctgatcaccggcatcaacacgggcggctcgtacaacccgagctactacgcggcgggcgccgaccgcaggctcgcgctcgcgcccgaggtggactgctcggtgctgctgagcggccacagcgcgcccgtgctctcgtgggattgcgtgctgatgctcgacccgatgggctccggcggcagcgcgacgcccgtgcatctcgagtaccgcggctcgtcgaccgcgcccggcagcccgtgcgcgacgcaaggcacgccgggcaacggcagctcggtcggcccgcaggtgcccgtgctgctccaatga

SEQ ID NO: 1148 - DNA, 462 bp, Burkholderia pseudomallei
atgaacacgcgccccttcgccctcgccgggcgccgcgcgcagcgcggcatggccgccgtcgagttcgcgctcgtcgccgcgatcctctgcacgatcctgatcggcatctgcgagttcggccgcgtgctgttctactggaacaccgcgagcgaggcggtccggctcggcgcgcgcacggcggccgtctgcgacgccgacgcgtccgtcgtgaaaacccgcatcggccagttgatgccgctcatcggcagcgcgaacgtgcgcctcgcgtacacgcccgccggctgcgattccgatgcggccaccgcgcgcagcacctgcacgttcgtcaccgtgtccgtcacgaacgtgacggtcaagacgctgattccgttcgtgccgctcacgctcgcgatgccgcccttcgtcaccacgctgccccgcgaaagtctcgcgacatcgacgggcggcacggtctgccaatga

SEQ ID NO: 1149 - DNA, 432 bp, Burkholderia pseudomallei
atgcatcaggaacggcgcaaacgcaacgccgatcgccatggcacgcatccgtacgatgcggactcacgcgcggcgcctcgcgaggcgccgcgcttcgaacacgagccgaagaaacagcgcgacgccgcgcagcacgaggtcgatcgtgatcgcgcggcgcgcgaaattcgcgagcgtatcgagcacaaggcgcggcccgacgttcgccgcgccgagcggccgatatcgcaggacgtggcccagacgccgatcggtgcggcaggcgcgatcagcccgtcaaccgcgcacagcatctttctcgagatcggcctggcgctcgccggtcgtccgattcaggtccgacgaaaccgggcgccgtttacacacggaacgccgcgccggcggccggcgcgcgggccgacggcgcgcaccgcctcgccggcgcctgtttga

SEQ ID NO: 1150 - DNA, 1128 bp, Burkholderia pseudomallei
atgaacgcgaaatcgatcgcggcggcggcgctcgccgtcgcgcaggcgggcctcgcccacgcacaatcgtcggtcacgctgtacggcgcgctcgatgcgggcgttctgtggcagaacacgtccgccgcgtcgttcagcccgacggcgccgaatacgggcgccgtcgtgcgcttcaaggacggcggcgtctattcgagcctctggggcatcaagggaacggaggatctcggcggcggctaccgcgtgaattttcggctgcaaggcgcgttcgacggcggcaccggcaagttcgggctgagcgacgcgcccggtgcggtcgccgcgttcaatcagatcgcgacgctcggcgtgtccgggccgttcggcacgttcaacgcgggccggcagatcgtaccgatgatctacgcgatggccgacaccgacgtgcgcgcggcgcgcttcttcggcagcgtgctgaccgcttggctcggcctgaataccgcggccggctggccgggcaacagcacgaacgcgccgatcggcgcgctctacgacagcgatgcgctcgtctaccagtcgcccgcgttcggcggcgcgtcgctcgcgctcgagtacgcgccgggcggtgtgcccggcggcgtgcagcgcggcgcgcgcgcgtcgatcgtgctcaagtacgcgtcgaacgcgctcaacctggccgccgtctattacaacggccacgacacgaatccggcgccgggcgcgagcgcgacgggactcgacaacaaccgcttcgtctacgtcggcgcgcagtacaagctgaaggatgtcgcggtgtcggcgtcgtacggcaacggccggaatcccgcgcgcggcgatcgcgtgaacctcgacatgttcgcgttcgggctcggctaccgcgtgtcgccgttctttcgcgtgagctcgggcgtctactacctgaaggaccggaaccgttcggcgaaccggtcgacgtcgatcgtgctcggcgccgattacgagctgtccaagcacaccacgctatatgcgcagggggggcgcgtcgacaatcgcggcacgatggctcagatgctggcgtacgggcagccggtcgcgccggggctcgcgacgaccgccgcgatgctagggatgcgtcattcgttctag

SEQ ID NO: 1151 - DNA, 25 bp, Artificial
  synthetic oligonucleotide
ctacccatacgatgttccggattac

SEQ ID NO: 1152 - DNA, 25 bp, Artificial
  synthetic oligonucleotide
ctcgagcatatgcttgtcgtcgtcg

SEQ ID NO: 1153 - DNA, 33 bp, Artificial
  synthetic oligonucleotide
catatcgacgacgacgacaagcatatgctcgag

SEQ ID NO: 1154 - DNA, 33 bp, Artificial
  synthetic oligonucleotide
atcttaagcgtaatccggaacatcgtatgggta

What is claimed is:

1. An isolated antigen composition comprising:

a plurality of immunodominant antigens of a pathogenic organism disposed on a solid carrier; and wherein the plurality of antigens are encoded by nucleic acids selected from the group consisting of SEQ ID NO:503 and SEQ ID NO:512, or fragments thereof.

2. The isolated antigen composition of claim 1 further comprising at least one additional antigen of *Brucella melitensis*, encoded by nucleic acids selected from the group consisting of SEQ ID NO:446 to SEQ ID NO:545.

3. The isolated antigen composition of claim 1 wherein the plurality of antigens is disposed on the carrier in an array.

4. The isolated antigen composition of claim 3 wherein each of the antigens are present in a purity of greater than 60%.

5. The isolated antigen composition of claim 3 wherein the antigens or fragments thereof are recombinant.

6. The isolated antigen composition of claim 3 wherein the antigens or fragments thereof are purified.

* * * * *